United States Patent 11,596,686 (CORONAVIRUS VACCINE) - sequence listing, part 9

SEQ ID NO: 12343 - RNA, 4094 nt, synthetic construct
  misc_feature 1..4094: note = SARS-CoV-2/Wuhan/WIV05/2019__EPI_ISL_402128 spike protein mRNA gc (1-1273)(I714C_Y1110C)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12344 - RNA, 4094 nt, synthetic construct
  misc_feature 1..4094: note = SARS-CoV-2/Wuhan/WIV05/2019__EPI_ISL_402128 spike protein mRNA gc (1-1273)(P715C_P1069C)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12345 - RNA, 4094 nt, synthetic construct
  misc_feature 1..4094: note = SARS-CoV-2/Wuhan/WIV05/2019__EPI_ISL_402128 spike protein mRNA gc (1-1273)(G889C_L1034C)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12346 - RNA, 4094 nt, synthetic construct
  misc_feature 1..4094: note = SARS-CoV-2/Wuhan/WIV05/2019__EPI_ISL_402128 spike protein mRNA gc (1-1273)(I909C_Y1047C)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12347 - RNA, 4094 nt, synthetic construct
  misc_feature 1..4094: note = SARS-CoV-2/Wuhan/WIV05/2019__EPI_ISL_402128 spike protein mRNA gc (1-1273)(Q965C_S1003C)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12348 - RNA, 4094 nt, synthetic construct
  misc_feature 1..4094: note = SARS-CoV-2/Wuhan/WIV05/2019__EPI_ISL_402128 spike protein mRNA gc (1-1273)(F970C_G999C)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12349 - RNA, 4094 nt, synthetic construct
  misc_feature 1..4094: note = SARS-CoV-2/Wuhan/WIV05/2019__EPI_ISL_402128 spike protein mRNA gc (1-1273)(A972C_R995C)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12350 - RNA, 4094 nt, synthetic construct
  misc_feature 1..4094: note = SARS-CoV-2/Wuhan/WIV05/2019__EPI_ISL_402128 spike protein mRNA gc (1-1273)(A890C_V1040C)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12351 - RNA, 4094 nt, synthetic construct
  misc_feature 1..4094: note = SARS-CoV-2/Wuhan/WIV05/2019__EPI_ISL_402128 spike protein mRNA gc (1-1273)(T874C_S1055C)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12352 - RNA, 2318 nt, synthetic construct; identical to SEQ ID NO: 152
  misc_feature 1..2318: note = SARS-CoV-2/Wuhan/WIV05/2019__EPI_ISL_402128 spike protein mRNA gc (1-681) R9489, R9493
  source 1..2318: mol_type = other RNA

SEQ ID NO: 12353 - RNA, 4388 nt, synthetic construct
  misc_feature 1..4388: note = SARS-CoV-2/Wuhan/WIV05/2019__EPI_ISL_402128 spike protein mRNA gc (1-1211) LumSynth construct
  source 1..4388: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12354 - RNA, 4388 nt, synthetic construct
  misc_feature 1..4388: note = SARS-CoV-2/Wuhan/WIV05/2019__EPI_ISL_402128 spike protein mRNA gc (1-1211)(K986P_V987P) LumSynth construct
  source 1..4388: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12355 - RNA, 4388 nt, synthetic construct
  misc_feature 1..4388: note = SARS-CoV-2/Wuhan/WIV05/2019__EPI_ISL_402128 spike protein mRNA gc (1-1211)(K986P_V987P_T887WN_A1020W) LumSynth construct
  source 1..4388: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12356 - RNA, 4388 nt, synthetic construct
  misc_feature 1..4388: note = SARS-CoV-2/Wuhan/WIV05/2019__EPI_ISL_402128 spike protein mRNA gc (1-1211)(K986P_V987P_P1069F) LumSynth construct
  source 1..4388: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12357 - RNA, 4388 nt, synthetic construct
  misc_feature 1..4388: note = SARS-CoV-2/Wuhan/WIV05/2019__EPI_ISL_402128 spike protein mRNA gc (1-1211)(K986P_V987P_ H1048Q_H1064N_ H1083N_H1101N) LumSynth construct
  source 1..4388: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12358 - RNA, 4388 nt, synthetic construct
  misc_feature 1..4388: note = SARS-CoV-2/Wuhan/WIV05/2019__EPI_ISL_402128 spike protein mRNA gc (1-1211)(I712C_T1077C) LumSynth construct
  source 1..4388: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12359 - RNA, 4388 nt, synthetic construct
  misc_feature 1..4388: note = SARS-CoV-2/Wuhan/WIV05/2019__EPI_ISL_402128 spike protein mRNA gc (1-1211)(I714C_Y1110C) LumSynth construct
  source 1..4388: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12360 - RNA, 4388 nt, synthetic construct
  misc_feature 1..4388: note = SARS-CoV-2/Wuhan/WIV05/2019__EPI_ISL_402128 spike protein mRNA gc (1-1211)(P715C_P1069C) LumSynth construct
  source 1..4388: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12361 - RNA, 4388 nt, synthetic construct
  misc_feature 1..4388: note = SARS-CoV-2/Wuhan/WIV05/2019__EPI_ISL_402128 spike protein mRNA gc (1-1211)(G889C_L1034C) LumSynth construct
  source 1..4388: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12362 - RNA, 4388 nt, synthetic construct
  misc_feature 1..4388: note = SARS-CoV-2/Wuhan/WIV05/2019__EPI_ISL_402128 spike protein mRNA gc (1-1211)(I909C_Y1047C) LumSynth construct
  source 1..4388: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12363 - RNA, 4388 nt, synthetic construct
  misc_feature 1..4388: note = SARS-CoV-2/Wuhan/WIV05/2019__EPI_ISL_402128 spike protein mRNA gc (1-1211)(Q965C_S1003C) LumSynth construct
  source 1..4388: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12364 - RNA, 4388 nt, synthetic construct
  misc_feature 1..4388: note = SARS-CoV-2/Wuhan/WIV05/2019__EPI_ISL_402128 spike protein mRNA gc (1-1211)(F970C_G999C) LumSynth construct
  source 1..4388: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12365 - RNA, 4388 nt, synthetic construct
  misc_feature 1..4388: note = SARS-CoV-2/Wuhan/WIV05/2019__EPI_ISL_402128 spike protein mRNA gc (1-1211)(A972C_R995C) LumSynth construct
  source 1..4388: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12366 - RNA, 4388 nt, synthetic construct
  misc_feature 1..4388: note = SARS-CoV-2/Wuhan/WIV05/2019__EPI_ISL_402128 spike protein mRNA gc (1-1211)(A890C_V1040C) LumSynth construct
  source 1..4388: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12367 - RNA, 4388 nt, synthetic construct
  misc_feature 1..4388: note = SARS-CoV-2/Wuhan/WIV05/2019__EPI_ISL_402128 spike protein mRNA gc (1-1211)(T874C_S1055C) LumSynth construct
  source 1..4388: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12368 - RNA, 4412 nt, synthetic construct
  misc_feature 1..4412: note = SARS-CoV-2/Wuhan/WIV05/2019__EPI_ISL_402128 spike protein mRNA gc (1-1211) Ferritin construct
  source 1..4412: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12369 - RNA, 4412 nt, synthetic construct
  misc_feature 1..4412: note = SARS-CoV-2/Wuhan/WIV05/2019__EPI_ISL_402128 spike protein mRNA gc (1-1211)(K986P_V987P) Ferritin construct
  source 1..4412: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12370 - RNA, 4412 nt, synthetic construct
  misc_feature 1..4412: note = SARS-CoV-2/Wuhan/WIV05/2019__EPI_ISL_402128 spike protein mRNA gc (1-1211)(K986P_V987P_T887WN_A1020W) Ferritin construct
  source 1..4412: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12371 - RNA, 4412 nt, synthetic construct
  misc_feature 1..4412: note = SARS-CoV-2/Wuhan/WIV05/2019__EPI_ISL_402128 spike protein mRNA gc (1-1211)(K986P_V987P_P1069F) Ferritin construct
  source 1..4412: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12372 - RNA, 4412 nt, synthetic construct
  misc_feature 1..4412: note = SARS-CoV-2/Wuhan/WIV05/2019__EPI_ISL_402128 spike protein mRNA gc (1-1211)(K986P_V987P_ H1048Q_H1064N_ H1083N_H1101N) Ferritin construct
  source 1..4412: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12373 - RNA, 4412 nt, synthetic construct
  misc_feature 1..4412: note = SARS-CoV-2/Wuhan/WIV05/2019__EPI_ISL_402128 spike protein mRNA gc (1-1211)(I712C_T1077C) Ferritin construct
  source 1..4412: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12374 - RNA, 4412 nt, synthetic construct
  misc_feature 1..4412: note = SARS-CoV-2/Wuhan/WIV05/2019__EPI_ISL_402128 spike protein mRNA gc (1-1211)(I714C_Y1110C) Ferritin construct
  source 1..4412: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12375 - RNA, 4412 nt, synthetic construct
  misc_feature 1..4412: note = SARS-CoV-2/Wuhan/WIV05/2019__EPI_ISL_402128 spike protein mRNA gc (1-1211)(P715C_P1069C) Ferritin construct
  source 1..4412: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12376 - RNA, 4412 nt, synthetic construct
  misc_feature 1..4412: note = SARS-CoV-2/Wuhan/WIV05/2019__EPI_ISL_402128 spike protein mRNA gc (1-1211)(G889C_L1034C) Ferritin construct
  source 1..4412: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12377 - RNA, 4412 nt, synthetic construct
  misc_feature 1..4412: note = SARS-CoV-2/Wuhan/WIV05/2019__EPI_ISL_402128 spike protein mRNA gc (1-1211)(I909C_Y1047C) Ferritin construct
  source 1..4412: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12378 - RNA, 4412 nt, synthetic construct
  misc_feature 1..4412: note = SARS-CoV-2/Wuhan/WIV05/2019__EPI_ISL_402128 spike protein mRNA gc (1-1211)(Q965C_S1003C) Ferritin construct
  source 1..4412: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12379 - RNA, 4412 nt, synthetic construct
  misc_feature 1..4412: note = SARS-CoV-2/Wuhan/WIV05/2019__EPI_ISL_402128 spike protein mRNA gc (1-1211)(F970C_G999C) Ferritin construct
  source 1..4412: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12380 - RNA, 4412 nt, synthetic construct
  misc_feature 1..4412: note = SARS-CoV-2/Wuhan/WIV05/2019__EPI_ISL_402128 spike protein mRNA gc (1-1211)(A972C_R995C) Ferritin construct
  source 1..4412: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12381 - RNA, 4412 nt, synthetic construct
  misc_feature 1..4412: note = SARS-CoV-2/Wuhan/WIV05/2019__EPI_ISL_402128 spike protein mRNA gc (1-1211)(A890C_V1040C) Ferritin construct
  source 1..4412: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12382 - RNA, 4412 nt, synthetic construct
  misc_feature 1..4412: note = SARS-CoV-2/Wuhan/WIV05/2019__EPI_ISL_402128 spike protein mRNA gc (1-1211)(T874C_S1055C) Ferritin construct
  source 1..4412: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12383 - RNA, 3998 nt, synthetic construct
  misc_feature 1..3998: note = SARS-CoV-2/Wuhan/WIV05/2019__EPI_ISL_402128 spike protein mRNA gc (1-1211) Foldon construct
  source 1..3998: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12384 - RNA, 3998 nt, synthetic construct
  misc_feature 1..3998: note = SARS-CoV-2/Wuhan/WIV05/2019__EPI_ISL_402128 spike protein mRNA gc (1-1211)(K986P_V987P) Foldon construct
  source 1..3998: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12385 - RNA, 3998 nt, synthetic construct
  misc_feature 1..3998: note = SARS-CoV-2/Wuhan/WIV05/2019__EPI_ISL_402128 spike protein mRNA gc (1-1211)(K986P_V987P_T887WN_A1020W) Foldon construct
  source 1..3998: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12386 - RNA, 3998 nt, synthetic construct
  misc_feature 1..3998: note = SARS-CoV-2/Wuhan/WIV05/2019__EPI_ISL_402128 spike protein mRNA gc (1-1211)(K986P_V987P_P1069F) Foldon construct
  source 1..3998: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12387 - RNA, 3998 nt, synthetic construct
  misc_feature 1..3998: note = SARS-CoV-2/Wuhan/WIV05/2019__EPI_ISL_402128 spike protein mRNA gc (1-1211)(K986P_V987P_ H1048Q_H1064N_ H1083N_H1101N) Foldon construct
  source 1..3998: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12388 - RNA, 3998 nt, synthetic construct
  misc_feature 1..3998: note = SARS-CoV-2/Wuhan/WIV05/2019__EPI_ISL_402128 spike protein mRNA gc (1-1211)(I712C_T1077C) Foldon construct
  source 1..3998: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12389 - RNA, 3998 nt, synthetic construct
  misc_feature 1..3998: note = SARS-CoV-2/Wuhan/WIV05/2019__EPI_ISL_402128 spike protein mRNA gc (1-1211)(I714C_Y1110C) Foldon construct
  source 1..3998: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12390 - RNA, 3998 nt, synthetic construct
  misc_feature 1..3998: note = SARS-CoV-2/Wuhan/WIV05/2019__EPI_ISL_402128 spike protein mRNA gc (1-1211)(P715C_P1069C) Foldon construct
  source 1..3998: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12391 - RNA, 3998 nt, synthetic construct
  misc_feature 1..3998: note = SARS-CoV-2/Wuhan/WIV05/2019__EPI_ISL_402128 spike protein mRNA gc (1-1211)(G889C_L1034C) Foldon construct
  source 1..3998: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12392 - RNA, 3998 nt, synthetic construct
  misc_feature 1..3998: note = SARS-CoV-2/Wuhan/WIV05/2019__EPI_ISL_402128 spike protein mRNA gc (1-1211)(I909C_Y1047C) Foldon construct
  source 1..3998: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12393 - RNA, 3998 nt, synthetic construct
  misc_feature 1..3998: note = SARS-CoV-2/Wuhan/WIV05/2019__EPI_ISL_402128 spike protein mRNA gc (1-1211)(Q965C_S1003C) Foldon construct
  source 1..3998: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12394 - RNA, 3998 nt, synthetic construct
  misc_feature 1..3998: note = SARS-CoV-2/Wuhan/WIV05/2019__EPI_ISL_402128 spike protein mRNA gc (1-1211)(F970C_G999C) Foldon construct
  source 1..3998: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12395 - RNA, 3998 nt, synthetic construct
  misc_feature 1..3998: note = SARS-CoV-2/Wuhan/WIV05/2019__EPI_ISL_402128 spike protein mRNA gc (1-1211)(A972C_R995C) Foldon construct
  source 1..3998: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12396 - RNA, 3998 nt, synthetic construct
  misc_feature 1..3998: note = SARS-CoV-2/Wuhan/WIV05/2019__EPI_ISL_402128 spike protein mRNA gc (1-1211)(A890C_V1040C) Foldon construct
  source 1..3998: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12397 - RNA, 3998 nt, synthetic construct
  misc_feature 1..3998: note = SARS-CoV-2/Wuhan/WIV05/2019__EPI_ISL_402128 spike protein mRNA gc (1-1211)(T874C_S1055C) Foldon construct
  source 1..3998: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12398 - RNA, 4370 nt, synthetic construct
  misc_feature 1..4370: note = SARS-CoV-2/Wuhan/WIV05/2019__EPI_ISL_402128 spike protein mRNA gc (1-1211) WhcAg construct
  source 1..4370: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12399 - RNA, 4370 nt, synthetic construct
  misc_feature 1..4370: note = SARS-CoV-2/Wuhan/WIV05/2019__EPI_ISL_402128 spike protein mRNA gc (1-1211)(K986P_V987P) WhcAg construct
  source 1..4370: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12400 - RNA, 4370 nt, synthetic construct
  misc_feature 1..4370: note = SARS-CoV-2/Wuhan/WIV05/2019__EPI_ISL_402128 spike protein mRNA gc (1-1211)(K986P_V987P_T887WN_A1020W) WhcAg construct
  source 1..4370: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12401 - RNA, 4370 nt, synthetic construct
  misc_feature 1..4370: note = SARS-CoV-2/Wuhan/WIV05/2019__EPI_ISL_402128 spike protein mRNA gc (1-1211)(K986P_V987P_P1069F) WhcAg construct
  source 1..4370: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12402 - RNA, 4370 nt, synthetic construct
  misc_feature 1..4370: note = SARS-CoV-2/Wuhan/WIV05/2019__EPI_ISL_402128 spike protein mRNA gc (1-1211)(K986P_V987P_ H1048Q_H1064N_ H1083N_H1101N) WhcAg construct
  source 1..4370: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12403 - RNA, 4370 nt, synthetic construct
  misc_feature 1..4370: note = SARS-CoV-2/Wuhan/WIV05/2019__EPI_ISL_402128 spike protein mRNA gc (1-1211)(I712C_T1077C) WhcAg construct
  source 1..4370: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12404 - RNA, 4370 nt, synthetic construct
  misc_feature 1..4370: note = SARS-CoV-2/Wuhan/WIV05/2019__EPI_ISL_402128 spike protein mRNA gc (1-1211)(I714C_Y1110C) WhcAg construct
  source 1..4370: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12405 - RNA, 4370 nt, synthetic construct
  misc_feature 1..4370: note = SARS-CoV-2/Wuhan/WIV05/2019__EPI_ISL_402128 spike protein mRNA gc (1-1211)(P715C_P1069C) WhcAg construct
  source 1..4370: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12406 - RNA, 4370 nt, synthetic construct
  misc_feature 1..4370: note = SARS-CoV-2/Wuhan/WIV05/2019__EPI_ISL_402128 spike protein mRNA gc (1-1211)(G889C_L1034C) WhcAg construct
  source 1..4370: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12407 - RNA, 4370 nt, synthetic construct
  misc_feature 1..4370: note = SARS-CoV-2/Wuhan/WIV05/2019__EPI_ISL_402128 spike protein mRNA gc (1-1211)(I909C_Y1047C) WhcAg construct
  source 1..4370: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12408 - RNA, 4370 nt, synthetic construct
  misc_feature 1..4370: note = SARS-CoV-2/Wuhan/WIV05/2019__EPI_ISL_402128 spike protein mRNA gc (1-1211)(Q965C_S1003C) WhcAg construct
  source 1..4370: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12409 - RNA, 4370 nt, synthetic construct
  misc_feature 1..4370: note = SARS-CoV-2/Wuhan/WIV05/2019__EPI_ISL_402128 spike protein mRNA gc (1-1211)(F970C_G999C) WhcAg construct
  source 1..4370: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12410 - RNA, 4370 nt, synthetic construct
  misc_feature 1..4370: note = SARS-CoV-2/Wuhan/WIV05/2019__EPI_ISL_402128 spike protein mRNA gc (1-1211)(A972C_R995C) WhcAg construct
  source 1..4370: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12411 - RNA, 4370 nt, synthetic construct
  misc_feature 1..4370: note = SARS-CoV-2/Wuhan/WIV05/2019__EPI_ISL_402128 spike protein mRNA gc (1-1211)(A890C_V1040C) WhcAg construct
  source 1..4370: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12412 - RNA, 4370 nt, synthetic construct
  misc_feature 1..4370: note = SARS-CoV-2/Wuhan/WIV05/2019__EPI_ISL_402128 spike protein mRNA gc (1-1211)(T874C_S1055C) WhcAg construct
  source 1..4370: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12413 - RNA, 4196 nt, synthetic construct
  misc_feature 1..4196: note = SARS-CoV-2/Wuhan/WIV05/2019__EPI_ISL_402128 spike protein mRNA gc (1-1147) LumSynth construct
  source 1..4196: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12414 - RNA, 4196 nt, synthetic construct
  misc_feature 1..4196: note = SARS-CoV-2/Wuhan/WIV05/2019__EPI_ISL_402128 spike protein mRNA gc (1-1147)(K986P_V987P) LumSynth construct
  source 1..4196: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12415 - RNA, 4196 nt, synthetic construct
  misc_feature 1..4196: note = SARS-CoV-2/Wuhan/WIV05/2019__EPI_ISL_402128 spike protein mRNA gc (1-1147)(K986P_V987P_T887WN_A1020W) LumSynth construct
  source 1..4196: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12416 - RNA, 4196 nt, synthetic construct
  misc_feature 1..4196: note = SARS-CoV-2/Wuhan/WIV05/2019__EPI_ISL_402128 spike protein mRNA gc (1-1147)(K986P_V987P_P1069F) LumSynth construct
  source 1..4196: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12417 - RNA, 4196 nt, synthetic construct
  misc_feature 1..4196: note = SARS-CoV-2/Wuhan/WIV05/2019__EPI_ISL_402128 spike protein mRNA gc (1-1147)(K986P_V987P_ H1048Q_H1064N_ H1083N_H1101N) LumSynth construct
  source 1..4196: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12418 - RNA, 4196 nt, synthetic construct
  misc_feature 1..4196: note = SARS-CoV-2/Wuhan/WIV05/2019__EPI_ISL_402128 spike protein mRNA gc (1-1147)(I712C_T1077C) LumSynth construct
  source 1..4196: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12419 - RNA, 4196 nt, synthetic construct
  misc_feature 1..4196: note = SARS-CoV-2/Wuhan/WIV05/2019__EPI_ISL_402128 spike protein mRNA gc (1-1147)(I714C_Y1110C) LumSynth construct
  source 1..4196: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12420 - RNA, 4196 nt, synthetic construct
  misc_feature 1..4196: note = SARS-CoV-2/Wuhan/WIV05/2019__EPI_ISL_402128 spike protein mRNA gc (1-1147)(P715C_P1069C) LumSynth construct
  source 1..4196: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12421 - RNA, 4196 nt, synthetic construct
  misc_feature 1..4196: note = SARS-CoV-2/Wuhan/WIV05/2019__EPI_ISL_402128 spike protein mRNA gc (1-1147)(G889C_L1034C) LumSynth construct
  source 1..4196: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12422 - RNA, 4196 nt, synthetic construct
  misc_feature 1..4196: note = SARS-CoV-2/Wuhan/WIV05/2019__EPI_ISL_402128 spike protein mRNA gc (1-1147)(I909C_Y1047C) LumSynth construct
  source 1..4196: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12423 - RNA, 4196 nt, synthetic construct
  misc_feature 1..4196: note = SARS-CoV-2/Wuhan/WIV05/2019__EPI_ISL_402128 spike protein mRNA gc (1-1147)(Q965C_S1003C) LumSynth construct
  source 1..4196: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12424 - RNA, 4196 nt, synthetic construct
  misc_feature 1..4196: note = SARS-CoV-2/Wuhan/WIV05/2019__EPI_ISL_402128 spike protein mRNA gc (1-1147)(F970C_G999C) LumSynth construct
  source 1..4196: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12425 - RNA, 4196 nt, synthetic construct
  misc_feature 1..4196: note = SARS-CoV-2/Wuhan/WIV05/2019__EPI_ISL_402128 spike protein mRNA gc (1-1147)(A972C_R995C) LumSynth construct
  source 1..4196: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12426 - RNA, 4196 nt, synthetic construct
  misc_feature 1..4196: note = SARS-CoV-2/Wuhan/WIV05/2019__EPI_ISL_402128 spike protein mRNA gc (1-1147)(A890C_V1040C) LumSynth construct
  source 1..4196: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12427 - RNA, 4196 nt, synthetic construct
  misc_feature 1..4196: note = SARS-CoV-2/Wuhan/WIV05/2019__EPI_ISL_402128 spike protein mRNA gc (1-1147)(T874C_S1055C) LumSynth construct
  source 1..4196: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12428 - RNA, 4220 nt, synthetic construct
  misc_feature 1..4220: note = SARS-CoV-2/Wuhan/WIV05/2019__EPI_ISL_402128 spike protein mRNA gc (1-1147) Ferritin construct
  source 1..4220: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12429 - RNA, 4220 nt, synthetic construct
  misc_feature 1..4220: note = SARS-CoV-2/Wuhan/WIV05/2019__EPI_ISL_402128 spike protein mRNA gc (1-1147)(K986P_V987P) Ferritin construct
  source 1..4220: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12430 - RNA, 4220 nt, synthetic construct
  misc_feature 1..4220: note = SARS-CoV-2/Wuhan/WIV05/2019__EPI_ISL_402128 spike protein mRNA gc (1-1147)(K986P_V987P_T887WN_A1020W) Ferritin construct
  source 1..4220: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12431 - RNA, 4220 nt, synthetic construct
  misc_feature 1..4220: note = SARS-CoV-2/Wuhan/WIV05/2019__EPI_ISL_402128 spike protein mRNA gc (1-1147)(K986P_V987P_P1069F) Ferritin construct
  source 1..4220: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12432 - RNA, 4220 nt, synthetic construct
  misc_feature 1..4220: note = SARS-CoV-2/Wuhan/WIV05/2019__EPI_ISL_402128 spike protein mRNA gc (1-1147)(K986P_V987P_ H1048Q_H1064N_ H1083N_H1101N) Ferritin construct
  source 1..4220: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12433 - RNA, 4220 nt, synthetic construct
  misc_feature 1..4220: note = SARS-CoV-2/Wuhan/WIV05/2019__EPI_ISL_402128 spike protein mRNA gc (1-1147)(I712C_T1077C) Ferritin construct
  source 1..4220: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12434 - RNA, 4220 nt, synthetic construct
  misc_feature 1..4220: note = SARS-CoV-2/Wuhan/WIV05/2019__EPI_ISL_402128 spike protein mRNA gc (1-1147)(I714C_Y1110C) Ferritin construct
  source 1..4220: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12435 - RNA, 4220 nt, synthetic construct
  misc_feature 1..4220: note = SARS-CoV-2/Wuhan/WIV05/2019__EPI_ISL_402128 spike protein mRNA gc (1-1147)(P715C_P1069C) Ferritin construct
  source 1..4220: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12436 - RNA, 4220 nt, synthetic construct
  misc_feature 1..4220: note = SARS-CoV-2/Wuhan/WIV05/2019__EPI_ISL_402128 spike protein mRNA gc (1-1147)(G889C_L1034C) Ferritin construct
  source 1..4220: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12437 - RNA, 4220 nt, synthetic construct
  misc_feature 1..4220: note = SARS-CoV-2/Wuhan/WIV05/2019__EPI_ISL_402128 spike protein mRNA gc (1-1147)(I909C_Y1047C) Ferritin construct
  source 1..4220: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12438 - RNA, 4220 nt, synthetic construct
  misc_feature 1..4220: note = SARS-CoV-2/Wuhan/WIV05/2019__EPI_ISL_402128 spike protein mRNA gc (1-1147)(Q965C_S1003C) Ferritin construct
  source 1..4220: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12439 - RNA, 4220 nt, synthetic construct
  misc_feature 1..4220: note = SARS-CoV-2/Wuhan/WIV05/2019__EPI_ISL_402128 spike protein mRNA gc (1-1147)(F970C_G999C) Ferritin construct
  source 1..4220: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12440 - RNA, 4220 nt, synthetic construct
  misc_feature 1..4220: note = SARS-CoV-2/Wuhan/WIV05/2019__EPI_ISL_402128 spike protein mRNA gc (1-1147)(A972C_R995C) Ferritin construct
  source 1..4220: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12441 - RNA, 4220 nt, synthetic construct
  misc_feature 1..4220: note = SARS-CoV-2/Wuhan/WIV05/2019__EPI_ISL_402128 spike protein mRNA gc (1-1147)(A890C_V1040C) Ferritin construct
  source 1..4220: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12442 - RNA, 4220 nt, synthetic construct
  misc_feature 1..4220: note = SARS-CoV-2/Wuhan/WIV05/2019__EPI_ISL_402128 spike protein mRNA gc (1-1147)(T874C_S1055C) Ferritin construct
  source 1..4220: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12443 - RNA, 3806 nt, synthetic construct
  misc_feature 1..3806: note = SARS-CoV-2/Wuhan/WIV05/2019__EPI_ISL_402128 spike protein mRNA gc (1-1147) Foldon construct
  source 1..3806: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12444 - RNA, 3806 nt, synthetic construct
  misc_feature 1..3806: note = SARS-CoV-2/Wuhan/WIV05/2019__EPI_ISL_402128 spike protein mRNA gc (1-1147)(K986P_V987P) Foldon construct
  source 1..3806: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12445 - RNA, 3806 nt, synthetic construct
  misc_feature 1..3806: note = SARS-CoV-2/Wuhan/WIV05/2019__EPI_ISL_402128 spike protein mRNA gc (1-1147)(K986P_V987P_T887WN_A1020W) Foldon construct
  source 1..3806: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12446 - RNA, 3806 nt, synthetic construct
  misc_feature 1..3806: note = SARS-CoV-2/Wuhan/WIV05/2019__EPI_ISL_402128 spike protein mRNA gc (1-1147)(K986P_V987P_P1069F) Foldon construct
  source 1..3806: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12447 - RNA, 3806 nt, synthetic construct
  misc_feature 1..3806: note = SARS-CoV-2/Wuhan/WIV05/2019__EPI_ISL_402128 spike protein mRNA gc (1-1147)(K986P_V987P_ H1048Q_H1064N_ H1083N_H1101N) Foldon construct
  source 1..3806: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12448 - RNA, 3806 nt, synthetic construct
  misc_feature 1..3806: note = SARS-CoV-2/Wuhan/WIV05/2019__EPI_ISL_402128 spike protein mRNA gc (1-1147)(I712C_T1077C) Foldon construct
  source 1..3806: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12449 - RNA, 3806 nt, synthetic construct
  misc_feature 1..3806: note = SARS-CoV-2/Wuhan/WIV05/2019__EPI_ISL_402128 spike protein mRNA gc (1-1147)(I714C_Y1110C) Foldon construct
  source 1..3806: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12450 - RNA, 3806 nt, synthetic construct
  misc_feature 1..3806: note = SARS-CoV-2/Wuhan/WIV05/2019__EPI_ISL_402128 spike protein mRNA gc (1-1147)(P715C_P1069C) Foldon construct
  source 1..3806: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12451 - RNA, 3806 nt, synthetic construct
  misc_feature 1..3806: note = SARS-CoV-2/Wuhan/WIV05/2019__EPI_ISL_402128 spike protein mRNA gc (1-1147)(G889C_L1034C) Foldon construct
  source 1..3806: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12452 - RNA, 3806 nt, synthetic construct
  misc_feature 1..3806: note = SARS-CoV-2/Wuhan/WIV05/2019__EPI_ISL_402128 spike protein mRNA gc (1-1147)(I909C_Y1047C) Foldon construct
  source 1..3806: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12453 - RNA, 3806 nt, synthetic construct
  misc_feature 1..3806: note = SARS-CoV-2/Wuhan/WIV05/2019__EPI_ISL_402128 spike protein mRNA gc (1-1147)(Q965C_S1003C) Foldon construct
  source 1..3806: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12454 - RNA, 3806 nt, synthetic construct
  misc_feature 1..3806: note = SARS-CoV-2/Wuhan/WIV05/2019__EPI_ISL_402128 spike protein mRNA gc (1-1147)(F970C_G999C) Foldon construct
  source 1..3806: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12455 - RNA, 3806 nt, synthetic construct
  misc_feature 1..3806: note = SARS-CoV-2/Wuhan/WIV05/2019__EPI_ISL_402128 spike protein mRNA gc (1-1147)(A972C_R995C) Foldon construct
  source 1..3806: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12456 - RNA, 3806 nt, synthetic construct
  misc_feature 1..3806: note = SARS-CoV-2/Wuhan/WIV05/2019__EPI_ISL_402128 spike protein mRNA gc (1-1147)(A890C_V1040C) Foldon construct
  source 1..3806: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12457 - RNA, 3806 nt, synthetic construct
  misc_feature 1..3806: note = SARS-CoV-2/Wuhan/WIV05/2019__EPI_ISL_402128 spike protein mRNA gc (1-1147)(T874C_S1055C) Foldon construct
  source 1..3806: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12458 - RNA, 4178 nt, synthetic construct
  misc_feature 1..4178: note = SARS-CoV-2/Wuhan/WIV05/2019__EPI_ISL_402128 spike protein mRNA gc (1-1147) WhcAg construct
  source 1..4178: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12459 - RNA, 4178 nt, synthetic construct
  misc_feature 1..4178: note = SARS-CoV-2/Wuhan/WIV05/2019__EPI_ISL_402128 spike protein mRNA gc (1-1147)(K986P_V987P) WhcAg construct
  source 1..4178: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12460 - RNA, 4178 nt, synthetic construct
  misc_feature 1..4178: note = SARS-CoV-2/Wuhan/WIV05/2019__EPI_ISL_402128 spike protein mRNA gc (1-1147)(K986P_V987P_T887WN_A1020W) WhcAg construct
  source 1..4178: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12461 - RNA, 4178 nt, synthetic construct
  misc_feature 1..4178: note = SARS-CoV-2/Wuhan/WIV05/2019__EPI_ISL_402128 spike protein mRNA gc (1-1147)(K986P_V987P_P1069F) WhcAg construct
  source 1..4178: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12462 - RNA, 4178 nt, synthetic construct
  misc_feature 1..4178: note = SARS-CoV-2/Wuhan/WIV05/2019__EPI_ISL_402128 spike protein mRNA gc (1-1147)(K986P_V987P_ H1048Q_H1064N_ H1083N_H1101N) WhcAg construct
  source 1..4178: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12463 - RNA, 4178 nt, synthetic construct
  misc_feature 1..4178: note = SARS-CoV-2/Wuhan/WIV05/2019__EPI_ISL_402128 spike protein mRNA gc (1-1147)(I712C_T1077C) WhcAg construct
  source 1..4178: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12464 - RNA, 4178 nt, synthetic construct
  misc_feature 1..4178: note = SARS-CoV-2/Wuhan/WIV05/2019__EPI_ISL_402128 spike protein mRNA gc (1-1147)(I714C_Y1110C) WhcAg construct
  source 1..4178: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12465 - RNA, 4178 nt, synthetic construct
  misc_feature 1..4178: note = SARS-CoV-2/Wuhan/WIV05/2019__EPI_ISL_402128 spike protein mRNA gc (1-1147)(P715C_P1069C) WhcAg construct
  source 1..4178: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12466 - RNA, 4178 nt, synthetic construct
  misc_feature 1..4178: note = SARS-CoV-2/Wuhan/WIV05/2019__EPI_ISL_402128 spike protein mRNA gc (1-1147)(G889C_L1034C) WhcAg construct
  source 1..4178: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12467 - RNA, 4178 nt, synthetic construct
  misc_feature 1..4178: note = SARS-CoV-2/Wuhan/WIV05/2019__EPI_ISL_402128 spike protein mRNA gc (1-1147)(I909C_Y1047C) WhcAg construct
  source 1..4178: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12468 - RNA, 4178 nt, synthetic construct
  misc_feature 1..4178: note = SARS-CoV-2/Wuhan/WIV05/2019__EPI_ISL_402128 spike protein mRNA gc (1-1147)(Q965C_S1003C) WhcAg construct
  source 1..4178: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12469 - RNA, 4178 nt, synthetic construct
  misc_feature 1..4178: note = SARS-CoV-2/Wuhan/WIV05/2019__EPI_ISL_402128 spike protein mRNA gc (1-1147)(F970C_G999C) WhcAg construct
  source 1..4178: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12470 - RNA, 4178 nt, synthetic construct
  misc_feature 1..4178: note = SARS-CoV-2/Wuhan/WIV05/2019__EPI_ISL_402128 spike protein mRNA gc (1-1147)(A972C_R995C) WhcAg construct
  source 1..4178: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12471 - RNA, 4178 nt, synthetic construct
  misc_feature 1..4178: note = SARS-CoV-2/Wuhan/WIV05/2019__EPI_ISL_402128 spike protein mRNA gc (1-1147)(A890C_V1040C) WhcAg construct
  source 1..4178: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12472 - RNA, 4178 nt, synthetic construct
  misc_feature 1..4178: note = SARS-CoV-2/Wuhan/WIV05/2019__EPI_ISL_402128 spike protein mRNA gc (1-1147)(T874C_S1055C) WhcAg construct
  source 1..4178: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12473 - RNA, 4094 nt, synthetic construct
  misc_feature 1..4094: note = SARS-CoV-2/Wuhan/WIV05/2019__EPI_ISL_402128 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcgttagcggcaattgtgatgtggtcatcgggatcgtgaacaatactgtatatgaccccctccaacctgagctggattccttcaaggaggaacttgacaaatactttaagaaccatacatcaccagatgtggacttgggagatattagtggcatcaatgccagcgtcgttaacattcagaaggaaatagaccgactgaatgaggtggctaaaaacttaaacgaatctctcatcgacctgcaggagcttggtaagtatgagcagtacattaaatggccctggtatatctggctggggttcattgcaggactaatcgccatagtgatggtcaccatcatgctctgctgtatgacttcctgctgttcatgcctgaagggctgttgcagttgtggtagctgctgcaaatttgatgaagacgattccgagcctgtgttgaagggcgttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12474 - RNA, 4082 nt, synthetic construct
  misc_feature 1..4082: note = SARS-CoV-2/bat/Yunnan/RaTG13/2013__EPI_ISL_402131 spike protein mRNA human (1-1269)
  source 1..4082: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacaccaattcttcaacgaggggcgtatattacccggacaaggtgttccggagtagcgtcctgcacctaacacaggatctctttctgcccttcttttccaacgtgacttggttccatgctatccacgtttctgggaccaatggaattaaacgctttgacaaccctgtgcttccattcaatgatggtgtctattttgcatcgacagagaagtcaaacataatccgaggctggattttcgggaccactctggacagcaaaacacagagtttgctcatcgtgaataacgccaccaatgtagttattaaggtgtgtgaatttcagttctgcaacgatccctttctgggagtctactatcataaaaataacaagtcctggatggagtctgagttccgtgtgtacagctccgcgaataactgtacgttcgaatatgtgtcacaaccttttctgatggacctcgaaggcaagcagggtaatttcaaaaacttaagagagtttgtcttcaagaacatcgatgggtactttaaaatatacagtaagcacactccaatcaatctggttagggaccttccccctggattcagcgctttggagccactggtggatctaccgattggcatcaacattacccggtttcagacactcctggcccttcatcgctcttatctgactcccggcgactcctcaagcgggtggaccgcaggagccgctgcatactatgtaggttacttgcagcctagaacattcctcctgaaatataatgaaaacggcaccatcacggatgccgtggactgcgctttagatccactgagtgagactaagtgtacactcaagtcttttaccgtcgaaaaagggatataccaaacttccaatttcagggtgcagcccacagacagcattgttcggtttcctaacatcaccaatctttgcccattcggagaggtgtttaacgccacgaccttcgcgtcggtctatgcatggaatcgcaagcgaatttctaactgtgtggccgactactccgtactgtacaattcaacaagtttcagcacttttaaatgctatggcgtttcccccaccaagttgaacgatctatgtttcacaaatgtgtacgctgactcttttgtcatcactggtgatgaggtgagacagatcgccccggggcagaccggaaaaattgcagactataactacaagctgcctgatgacttcacaggctgcgtcatagcttggaatagcaaacacatcgatgccaaggaaggcgggaactttaactatctctacaggctgttccggaaggcgaatcttaaaccctttgagcgtgacatttcaaccgaaatctatcaagccggaagtaagccatgtaacggtcagactggcctgaattgctactaccctttgtatcgctacgggttctatcccacggatggagtgggccaccagccatacagagttgtggtactctcctttgagctgttaaacgcacccgctacagtctgcggtcctaaaaagagcaccaatctggtgaaaaacaagtgtgttaatttcaactttaatgggctaactggcaccggagtgctcacagaatctaacaagaaattcctgccatttcaacagttcggcagggacatagccgataccactgacgctgtccgggacccgcagacacttgagattttggatatcacgccctgctcattcgggggagtgagtgtaatcacccctggtactaatgccagcaaccaggtggcagttctgtatcaagacgtcaattgtacagaggtgccagtggccattcatgctgatcagctcacccccacatggcgagtctactccactggctctaacgtttttcagacccgcgcggggtgcctgatcggagcagaacacgtgaataactcgtatgagtgtgacattcctataggcgccggtatctgcgctagctaccagacgcaaaccaactccagatcagtggccagtcagtctattatcgcatacacaatgagccttggggccgaaaattccgtagcttattcaaacaatagcatcgccattccaactaacttcaccatatctgtcacaactgagatcctgcccgtgtccatgaccaagacgagtgttgattgtacaatgtacatttgcggcgacagcaccgaatgttctaatttgctcctgcagtatggatccttttgcactcagttaaacagggcactgacaggcatcgcggtggagcaagataaaaatacccaggaggtcttcgctcaggtgaagcagatttacaaaactccgcctatcaaggactttgggggattcaacttttcacaaatactaccagatcccagtaagcctagcaaacggtcgttcatcgaagacctcctgtttaataaggttacccttgccgatgcaggtttcattaaacagtatggcgactgtttgggggatatcgccgctcgcgacctgatttgcgcccagaagtttaacggactcacagtgctgcccccattactgacggacgagatgatcgcacaatacacctccgctcttttggccggcactataacatctggttggaccttcggggcgggcgccgctctccagattcctttcgcaatgcagatggcctatagatttaatggaatcggcgtaacacagaacgtcctgtacgaaaatcaaaaactaattgctaaccagttcaatagcgccatcgggaagatacaggattcactgagttccactgcatctgcgctcggaaagctgcaggacgtggtgaaccaaaacgcccaggctcttaataccttggtcaaacagctgagctccaactttggcgccatctcaagcgttttaaatgatattctcagtaggctggacaaggtggaggcagaagtacagatcgatcgtcttattacgggtcggctgcaatctttgcagacatacgtgacccagcaactcatccgagctgccgagataagagcatccgccaacctggctgcgactaaaatgagcgagtgcgtcctagggcagtcgaagagggtggacttctgtggaaaaggctatcatctgatgtcatttccccagtctgccccacacggtgttgtgttcctccacgtcacctacgtgccggcacaggaaaagaattttacaactgctcctgccatttgccatgatggcaaagcccacttcccccgcgagggggtttttgtgagtaacggaacccattggttcgtcacacaacggaatttttatgaaccacagatcatcacgaccgacaacactttcgtatccggcagctgtgatgtggttattgggatcgtgaataacacagtctacgaccccctgcagcctgagcttgattcttttaaggaggaattggacaagtatttcaaaaatcacaccagcccagatgtggacctgggagacatttccggcataaacgcttcagtagtgaatatccagaaggagattgatagattaaacgaagtcgccaaaaatctcaacgagagtctgatcgaccttcaagaactgggtaagtacgagcagtatattaaatggccctggtacatctggctagggttcatagcaggactcatcgcgattatcatggttactattatgctgtgctgtatgacaagctgctgttcttgcttgaagggctgttgctcctgtggttcatgctgcaagtttgatgaggacgatagtgaacctgtgctgaaaggcgtgaagttacattacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12475 - RNA, 4094 nt, synthetic construct
  misc_feature 1..4094: note = SARS-CoV-2/Wuhan/HBCDC-HB-01/2019__EPI_ISL_402132 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctatcaccaggggcgtatattacccggacaaggtgttccggtcaagtgtcctgcacagcacacaggatctatttctccccttcttttccaacgtgacttggttccatgctattcacgtttctgggaccaatggaacaaaacgctttgacaaccctgtgctgccattcaatgatggtgtctattttgcatcgaccgagaagtcaaacataatccgaggctggattttcgggactacacttgacagcaaaacccagagtctgttgatcgtgaataacgccacgaatgtagttattaaggtgtgtgaatttcagttctgcaacgatccctttctcggagtctactatcataaaaataacaagtcctggatggagtctgagttccgtgtgtacagctccgcgaataactgtactttcgagtatgtgtcacaaccttttctgatggacctggaaggcaagcagggtaatttcaaaaacctcagagagtttgtcttcaagaacatcgatgggtactttaaaatatacagtaagcacaccccaatcaatttagttagggacctgccccagggattcagcgctcttgagcctttggtggatctgccaattggcatcaacattacacggtttcagactctactcgccctgcatcgctcttatcttaccccgggcgactcctcaagcgggtggacagcaggagccgctgcatactatgtaggttacctgcaacccagaaccttcttgctcaaatataatgaaaacggcacgatcactgatgccgtggactgcgctctggatcctttaagtgagacaaagtgtaccctgaagtcttttactgtcgaaaaagggatataccagacatccaatttcagggtgcagccaaccgagagcattgttcggtttcccaacatcacgaatctctgccctttcggagaggtgtttaacgccacccgcttcgcgtcggtctatgcatggaatcgaaagagaatttctaactgtgtggccgactactccgtactttacaattcagctagtttcagcacatttaaatgctatggcgtttccccaactaagctgaacgacttgtgtttcaccaatgtgtacgccgattcttttgtcatcaggggtgacgaagtgcggcagatcgcacccgggcaaacaggaaaaattgctgattataactacaagctaccggacgatttcactggctgcgtcatagcctggaatagcaacaacctggactcaaaagtgggcgggaattataactacctctatcgtctgtttcgcaagagtaatcttaagcctttcgagagagatatctccaccgaaatttaccaggcgggaagcacaccctgtaacggtgttgagggctttaattgctacttcccactgcagtcttatgggtttcaacctaccaacggagtgggctaccagccctatagggtagtcgtgttgtcattcgaactcctgcacgccccagcaactgtttgcggtcccaaaaagagtacgaatttagtgaaaaacaagtgtgtcaattttaacttcaatgggctgacaggcaccggagtgctaactgagagcaacaaaaagtttctccctttccagcagttcggccgggacatcgctgataccacagacgccgtacgagatccacaaaccctggagatacttgacattactccgtgctcctttgggggagtgtctgttatcacacccggtacgaatacctcgaaccaggtcgctgtgttgtaccaggacgtgaattgtactgaagtccctgttgccatccacgcagatcagctgacaccaacctggcgcgtgtatagcacaggctccaacgtgttccaaactagagccgggtgcctcattggagctgagcatgtaaacaattcatacgaatgtgacatccccattggcgcgggtatatgcgcaagttatcagacccagacgaactctcctaggcgggcccgcagcgtcgcttcccagtcaatcattgcctacaccatgagcctgggggcagaaaattctgtggcctactccaacaatagtatcgctatcccaacaaactttactattagcgttaccacagaaatacttcccgtgtctatgactaagacctccgtcgattgtacgatgtatatctgcggcgactcaacagagtgtagtaatctgttgctccaatacggcagcttctgcacccagctgaacagagccttaactggaattgcagtggagcaggataaaaatacacaggaagtttttgcgcaagtgaagcagatctataaaaccccgcctattaaggacttcgggggatttaacttctcgcagatcctgccagatccctccaaaccttctaagaggagctttatagaggacctactcttcaataaggtaactctggctgatgccggttttatcaaacaatacggcgactgtcttggggatattgcagcccgtgacttgatctgcgctcagaagttcaacggactgaccgtcctgcccccactcttaacagatgaaatgattgcccagtatacgtcagcactgcttgctggcaccatcacgagtggttggacattcggggccggcgcggccttgcagataccttttgctatgcaaatggcataccggttcaatggaattggcgtgacccagaacgtgctctatgagaatcagaaactgatcgccaaccagtttaactccgctattgggaagatccaagactctctaagctccacagcctcagcactgggaaaactccaggacgtcgttaatcagaacgcgcaggccctgaatactcttgtgaagcaattgagcagtaacttcggcgctatatcttccgtactgaatgatatcttaagccgactcgacaaggtggaagccgaggtccagattgatagactgatcaccggtaggcttcagtcgctgcaaacgtacgtgacacagcagttgattcgcgcagctgagatccgggcctcagcaaacctcgccgctaccaaaatgtctgaatgcgttctggggcagagtaagagagtggacttttgtggaaaaggctaccacctaatgtccttcccccaaagcgcgccacatggtgtcgtgtttctgcacgttacttatgtgccggcccaggagaagaatttcaccacagctcctgcaatatgccacgatggcaaagcccattttcccagggaaggggtcttcgtatctaacggaactcactggtttgtgacccagcgcaatttctacgagccacagattatcacaacggacaacacctttgttagcggcaattgtgatgtggtcatcgggattgtgaacaatactgtatatgaccccctccaacctgagctggattccttcaaggaggaacttgacaaatacttcaagaaccatacatcaccagatgtggacttgggagatatcagtggcattaatgccagcgtcgttaacatacagaaggaaatcgaccgactgaatgaggtggctaaaaacttaaacgaatctctcattgacctgcaggagcttggtaagtatgagcagtacatcaaatggccctggtatatttggctggggtttatcgcaggactaatagccatcgtgatggtcaccattatgctctgctgtatgacttcctgctgttcatgcctgaagggctgttgcagttgtggtagctgctgcaaattcgatgaagacgattccgagcctgtgttgaagggcgttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12476 - RNA, 4094 nt, synthetic construct
  misc_feature 1..4094: note = SARS-CoV-2/Guangdong/20SF028/2020__EPI_ISL_403936 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgtatagcacacaggatctattcctcccctttttctccaacgtgacttggtttcacgctatccatgtttctgggaccaatggaacaaaacgcttcgacaaccctgtgctgccatttaatgatggtgtctacttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctattaccacaaaaataacaagtcctggatggagtctgagttccgtgtgtatagctccgcgaataactgtacttttgaatacgtgtcacaacctttcctgatggacctggaaggcaagcagggtaattttaaaaacctcagagagttcgtctttaagaacattgatgggtacttcaaaatctatagtaagcataccccaataaatttagttagggacctgccccagggatttagcgctcttgagcctttggtggatctgccaatcggcattaacatcacacggttccagactctactcgccctgcaccgctcttaccttaccccgggcgactcctcaagcgggtggacagcaggagccgctgcatattacgtaggttatctgcaacccagaacctttttgctcaaatacaatgaaaacggcacgattactgatgccgtggactgcgctctggatcctttaagtgagacaaagtgtaccctgaagtctttcactgtcgaaaaagggatctatcagacatccaattttagggtgcagccaaccgagagcatagttcggttccccaacattacgaatctctgcccttttggagaggtgttcaacgccacccgcttcgcgtcggtctacgcatggaatcgaaagagaatctctaactgtgtggccgactactccgtactttataattcagctagttttagcacattcaaatgctacggcgtttccccaactaagctgaacgacttgtgttttaccaatgtgtatgccgattctttcgtcattaggggtgacgaagtgcggcagatcgcacccgggcaaacaggaaaaatcgctgattacaactataagctaccggacgattttactggctgcgtcattgcctggaatagcaacaacctggactcaaaagtgggcgggaattacaactatctctaccgtctgttccgcaagagtaatcttaagccttttgagagagatatatccaccgaaatctaccaggcgggaagcacaccctgtaacggtgttgagggcttcaattgctattttccactgcagtcttacgggttccaacctaccaacggagtgggctatcagccctacagggtagtcgtgttgtcatttgaactcctgcatgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtatcaggacgtgaattgtactgaagtccctgttgccatccacgcagatcagctgacaccaacctggcgcgtgtacagcacaggctccaacgtgtttcaaactagagccgggtgcctcatcggagctgagcacgtaaacaattcatatgaatgtgacattcccatcggcgcgggtatttgcgcaagttaccagacccagacgaactctcctaggcgggcccgcagcgtcgcttcccagtcaataatcgcctacaccatgagcctgggggcagaaaattctgtggcctattccaacaatagtattgctatcccaacaaacttcactatcagcgttaccacagaaattcttcccgtgtctatgactaagacctccgtcgattgtacgatgtacatatgcggcgactcaacagagtgtagtaatctgttgctccaatatggcagcttttgcacccagctgaacagagccttaactggaatcgcagtggagcaggataaaaatacacaggaagttttcgcgcaagtgaagcagatttacaaaaccccgcctatcaaggactttgggggattcaacttttcgcagattctgccagatccctccaaaccttctaagaggagcttcatcgaggacctactctttaataaggtaactctggctgatgccggtttcataaaacaatatggcgactgtcttggggatatcgcagcccgtgacttgatttgcgctcagaagttcaacggactgaccgtcctgcccccactcttaacagatgaaatgatcgcccagtacacgtcagcactgcttgctggcaccattacgagtggttggacatttggggccggcgcggccttgcagatccctttcgctatgcaaatggcatatcggtttaatggaataggcgtgacccagaacgtgctctacgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctatcatctaatgtcctttccccaaagcgcgccacacggtgtcgtgttcctgcatgttacttacgtgccggcccaggagaagaattttaccacagctcctgcaatctgccacgatggcaaagcccacttccccagggaaggggtctttgtatctaacggaactcattggttcgtgacccagcgcaatttttatgagccacagataattacaacggacaacaccttcgttagcggcaattgtgatgtggtcatcgggatcgtgaacaatactgtatacgaccccctccaacctgagctggattccttcaaggaggaacttgacaaatattttaagaaccacacatcaccagatgtggacttgggagatattagtggcatcaatgccagcgtcgttaacattcagaaggaaatagaccgactgaatgaggtggctaaaaacttaaacgaatctctcatcgacctgcaggagcttggtaagtacgagcagtatattaaatggccctggtacatctggctggggttcattgcaggactaatcgccatagtgatggtcaccatcatgctctgctgtatgacttcctgctgttcatgcctgaagggctgttgcagttgtggtagctgctgcaaatttgatgaagacgattccgagcctgtgttgaagggcgttaagctgcattacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12477 - RNA, 4094 nt, synthetic construct
  misc_feature 1..4094: note = SARS-CoV-2/Shenzhen/SZTH-001/2020__EPI_ISL_406592 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcgttagcggcaattgtgatgtgctcatcgggatcgtcaacaatactgtgtatgaccccctgcaacctgagcttgattccttcaaggaagagttggacaaatactttaagaaccatacatcaccagatgtagacctgggagatattagtggcatcaatgccagcgtggtcaacattcagaaggaaatagaccgattaaatgaggttgctaaaaacctcaacgaatctctgatcgaccttcaggagctgggtaagtatgagcagtacattaaatggccctggtatatctggctagggttcattgcaggactcatcgccatagtgatggtgaccatcatgctgtgctgtatgacttcctgctgttcatgcttgaagggctgttgcagttgtggtagctgctgcaaatttgatgaagacgattccggccctgtcctgaagggggtgaagttacactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12478 - RNA, 4094 nt, synthetic construct
  misc_feature 1..4094: note = SARS-CoV-2/Shenzhen/SZTH-004/2020__EPI_ISL_406595 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacacgaatagcttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatgggaccgaaagagaatctctaattgtgtggcctactactccgtactttataactcagctagttttagcacattcaaatgctacggcgtttccccaactaagctgaatgacttgtgttttaccaacgtgtatgccgattctttcgtcattaggggtgacgaagtgcggcagatcgcacccgggcaaacaggaaaaatcgctgattacaattataagctaccggacgattttactggctgcgtcattgcctggaacagcaataacctggactcaaaagtgggcgggaactacaattatctctaccgtctgttccgcaagagtaaccttaagccttttgagagagatatatccaccgaaatctaccaggcgggaagcacaccctgtaatggtgttgagggcttcaactgctattttccactgcagtcttacgggttccaacctaccaatggagtgggctatcagccctacagggtagtcgtgttgtcatttgaactcctgcacgccccagcaactgtttgcggtcccaaaaagagtacgaacttagtgaaaaataagtgtgtcaacttcaattttaacgggctgacaggcaccggagtgctaactgagagcaataaaaagttcctccctttccagcagtttggccgggacattgctgataccacagacgccgtacgagatccacaaaccctggagatccttgacataactccgtgctccttcgggggagtgtctgttattacacccggtacgaacacctcgaatcaggtcgctgtgttgtatcaggacgtgaactgtactgaagtccctgttgccatccacgcagatcagctgacaccaacctggcgcgtgtacagcacaggctccaatgtgtttcaaactagagccgggtgcctcatcggagctgagcatgtaaacaactcatatgaatgtgacattcccatcggcgcgggtatttgcgcaagttaccagacccagactaattctcctaggcgggcccgcagcgtcgcttcccagtcaataatcgcctacaccatgagcctgggggcagagaactctgtggcctattccaataacagtattgctatcccaacaaatttcactatcagcgttaccacagaaattcttcccgtgtctatgactaagacctccgtcgattgtacgatgtacatatgcggcgactcaacagagtgtagtaacctgttgctccaatatggatctttttgcacccagctgaatagagccttaactggcatcgcagtggagcaggataaaaacacacaggaagttttcgcgcaagtgaagcagatttacaaaaccccgcctatcaaggactttgggggattcaatttttcgcagattctgccagatccctccaaaccttctaagaggagcttcatcgaggacctactctttaacaaggtaactctggctgatgccggtttcataaaacaatatggcgactgtcttggggatatcgcagcccgtgacttgatttgcgctcagaagttcaatggactgaccgtcctgcccccactcttaacagatgaaatgatcgcccagtacacgtcagcactgcttgctggcaccattacgagtggttggacatttggggccggcgcggccttgcagatccctttcgctatgcaaatggcatatcggtttaacggaataggcgtgacccagaatgtgctctacgagaaccagaaactgattgccaatcagttcaactccgctatcgggaagattcaagactctctaagctccacagcctcagcactgggaaaactccaggacgtcgttaaccagaatgcgcaggccctgaacactcttgtgaagcaattgagcagtaattttggcgctatctcttccgtactgaacgatatattaagccgactcgacaaggtggaagccgaggtccagatcgatagactgattaccggtaggcttcagtcgctgcaaacgtacgtgacacagcagttgatccgcgcagctgagattcgggcctcagcaaatctcgccgctaccaaaatgtctgaatgcgttctggggcagagtaagagagtggacttctgtggaaaaggctatcacctaatgtcctttccccaaagcgcgccacatggtgtcgtgttcctgcacgttacttacgtgccggcccaggagaagaactttaccacagctcctgcaatctgccacgatggcaaagcccatttccccagggaaggggtctttgtatctaatggaactcactggttcgtgacccagcgcaacttttatgagccacagataattacaacggacaataccttcgttagcggcaactgtgatgtggtcatcgggatcgtgaataacactgtatacgaccccctccaacctgagctggattccttcaaggaagaacttgacaaatattttaagaatcatacatcaccagatgtggacttgggagatattagtggcatcaacgccagcgtcgttaatattcagaaggaaatagaccgactgaacgaggtggctaaaaatttaaacgaatctctcatcgacctgcaggagcttggtaagtacgagcagtatattaaatggccctggtacatctggctggggttcattgcaggactaatcgccatagtgatggtcaccatcatgctctgctgtatgacttcctgctgttcatgcctgaagggctgttgcagttgtggtagctgctgcaaatttgatgaagacgattccgagcctgtgttgaagggcgttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12479 - RNA, 4094 nt, synthetic construct
  misc_feature 1..4094: note = SARS-CoV-2/France/IDF0372/2020__EPI_ISL_406596 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactcctttctttacaattcagctagtttcagcacatttaaatgctatggcgtatccccaactaagctgaacgacttgtgtttcaccaatgtttacgccgattcttttgtgattaggggtgacgaagtccggcagatcgcacccgggcaaacaggaaaaatcgctgattataactacaagctaccggacgatttcactggctgcgtgattgcctggaatagcaacaacctggactcaaaagtcggcgggaattataactacctctatcgtctgtttcgcaagagtaatcttaagcctttcgagagagatatatccaccgaaatctaccaggcgggaagcacaccctgtaacggtgtggagggctttaattgctacttcccactgcagtcttatgggtttcaacctaccaacggagttggctaccagccctatagggtggtagtcttgtcattcgaactcctgcacgccccagcaactgtgtgcggtcccaaaaagagtacgaatttagttaaaaacaagtgtgtgaattttaacttcaatgggctgacaggcaccggagtcctaactgagagcaacaaaaagttcctcccttttcagcagttcggccgggacattgctgataccacagacgccgtgcgagatccacaaaccctggagatccttgacataactccgtgctcctttgggggagtatctgtgattacacccggtacgaatacctcgaaccaggttgctgtcttgtaccaggacgtgaattgtactgaagtgcctgtcgccatccacgcagatcagctgacaccaacctggcgcgtttatagcacaggctccaacgtgttccaaactagagccgggtgcctcatcggagctgagcatgtgaacaattcatacgaatgtgacattcccatcggcgcgggtatttgcgcaagttatcagacccagacgaactctcctaggcgggcccgcagcgtagcttcccagtcaataatcgcctacaccatgagcctgggggcagaaaattctgtcgcctactccaacaatagtattgctatcccaacaaactttactatcagcgtgaccacagaaattcttcccgtttctatgactaagacctccgtggattgtacgatgtatatatgcggcgactcaacagagtgtagtaatctgttgctccaatacggcagcttctgcacccagctgaacagagccttaactggaatcgcagtcgagcaggataaaaatacacaggaagtgtttgcgcaagttaagcagatttataaaaccccgcctatcaaggacttcgggggatttaacttctcgcagattctgccagatccctccaaaccttctaagaggagctttatcgaggacctactcttcaataaggtgactctggctgatgccggtttcataaaacaatacggcgactgtcttggggatatcgcagcccgtgacttgatttgcgctcagaagtttaacggactgaccgtactgcccccactcttaacagatgaaatgatcgcccagtatacgtcagcactgcttgctggcaccattacgagtggttggacattcggggccggcgcggccttgcagatcccttttgctatgcaaatggcataccggttcaatggaataggcgtcacccagaacgtgctctatgagaatcagaaactgattgccaaccagtttaactccgctatcgggaagattcaagactctctaagctccacagcctcagcactgggaaaactccaggacgtggtcaatcagaacgcgcaggccctgaatactcttgttaagcaattgagcagtaacttcggcgctatctcttccgtgctgaatgatatattaagccgactcgacaaggtagaagccgaggtgcagatcgatagactgattaccggtaggcttcagtcgctgcaaacgtacgtcacacagcagttgatccgcgcagctgagattcgggcctcagcaaacctcgccgctaccaaaatgtctgaatgcgtgctggggcagagtaagagagttgacttttgtggaaaaggctaccacctaatgtccttcccccaaagcgcgccacatggtgtggtctttctgcacgtgacttatgttccggcccaggagaagaatttcaccacagctcctgcaatctgccacgatggcaaagcccattttcccagggaaggggtgttcgtctctaacggaactcactggtttgtaacccagcgcaatttctacgagccacagataattacaacggacaacaccttcgtgagcggcaattgtgatgttgtgatcgggatcgtcaacaatactgtgtatgaccccctccaacctgagctggattcctttaaggaggaacttgacaaatacttcaagaaccatacatcaccagatgtagacttgggagatattagtggcatcaatgccagcgtggtcaacattcagaaggaaatagaccgactgaatgaggttgctaaaaacttaaacgaatctctcatcgacctgcaggagcttggtaagtatgagcagtacattaaatggccctggtatatctggctggggtttattgcaggactaatcgccatagtgatggtgaccatcatgctctgctgtatgacttcctgctgttcatgcctgaagggctgttgcagttgtggtagctgctgcaaattcgatgaagacgattccgagcctgtcttgaagggcgtgaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12480 - RNA, 4094 nt, synthetic construct
  misc_feature 1..4094: note = SARS-CoV-2/Australia/VIC01/2020__EPI_ISL_406844 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacaccaattctttcacgaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgcagatatcttaccccgggcgactcttcctcagggtggacagcaggagccgctgcatactatgtaggttacctgcaacccaggacctttttgctcaaatataatgaaaacggcacgattactgatgccgtggactgcgctctggatcctttaagcgagacaaagtgtaccctgaagagtttcactgtcgaaaaagggatctaccagacatctaattttcgggtgcagccaaccgagtccatagttcgcttccccaacattacgaatctctgcccttttggagaggtgttcaacgccacccgattcgcgagcgtctatgcatggaatagaaagaggatctcgaactgtgtggccgactactctgtactttacaattccgcttcatttagtacattcaaatgctatggcgttagcccaactaagctgaacgacttgtgttttaccaatgtgtacgccgattccttcgtcattcggggtgacgaagtgcgtcagatcgcacccgggcaaacaggaaaaatcgctgattataactacaagctaccggacgattttactggctgcgtcattgcctggaactctaataacctggacagcaaagtgggcgggaattataactacctctatcgcctgttcagaaagtcaaatcttaagccttttgagagggatataagtaccgaaatctaccaggcgggatccacaccctgtaacggtgttgagggcttcaattgctactttccactgcagagctatgggttccaacctaccaacggagtgggctaccagccctatcgggtagtcgtgttgtcttttgaactcctgcacgccccagcaactgtttgcggtcccaaaaagtcaacgaatttagtgaaaaacaagtgtgtcaatttcaactttaatgggctgacaggcaccggagtgctaactgagagtaacaaaaagttcctccctttccagcagtttggccgagacattgctgataccacagacgccgtacgcgatccacaaaccctggagatccttgacataactccgtgcagcttcgggggagtgtccgttattacacccggtacgaatacctctaaccaggtcgctgtgttgtaccaggacgtgaattgtactgaagtccctgttgccatccacgcagatcagctgacaccaacctggagagtgtattcgacaggcagcaacgtgtttcaaactagggccgggtgcctcatcggagctgagcatgtaaacaattcctacgaatgtgacattcccatcggcgcgggtatttgcgcatcatatcagacccagacgaacagtcctcggcgcgccagatctgtcgctagccagtccataatcgcctacaccatgtcactgggggcagagaatagcgtggcctactctaacaattccattgctatcccaacaaacttcactatcagtgttaccacagaaattcttcccgtgagcatgactaagacctctgtcgattgtacgatgtatatatgcggcgactccacagagtgttcaaatctgttgctccaatacggaagtttttgcacccagctgaacagggccttaactggcatcgcagtggagcaggataaaaatacacaggaagttttcgcgcaagtgaagcagatttataaaaccccgcctatcaaggactttgggggattcaactttagccagattctgccagatccctcgaaaccttccaagcgttctttcatcgaggacctactctttaataaggtaactctggctgatgccggtttcataaaacaatacggcgactgtcttggggatatcgcagcccgggacttgatttgcgctcagaagttcaacggactgaccgtcctccctccactgttaacagatgaaatgatcgcccagtatacgagcgcactgcttgctggcaccattacttcaggttggacatttggggccggcgcggccttgcagatccctttcgctatgcaaatggcataccgatttaatggaataggcgtgacccagaacgtgctctatgagaatcagaaactgattgccaaccagttcaacagtgctatcgggaagattcaagactccctatctagcacagcctccgcactgggaaaactccaggacgtcgttaatcagaacgcgcaggccctgaatactcttgtgaagcaattgtcaagcaactttggcgctatcagttctgtactgaatgatatattatccagactcgacaaggtggaagccgaggtccagatcgataggctgattaccggtcgccttcagagcctgcaaacgtacgtgacacagcagttgatccgggcagctgagattagagcctcggcaaacctcgccgctaccaaaatgtcagaatgcgttctggggcagtctaagagggtggacttctgtggaaaaggctaccacctaatgagttttccccaatccgcgccacatggtgtcgtgttcctgcacgttacttatgtgccggcccaggagaagaattttaccacagcacccgctatctgccacgatggcaaagcccatttcccccgcgaaggggtctttgtaagcaacggaactcactggttcgtgacccagcgaaatttttacgagccacagataattacaacggacaacaccttcgtttctggcaattgtgatgtggtcatcgggatcgtgaacaatactgtatatgaccccctccaacctgagctggatagcttcaaggaagaacttgacaaatactttaagaaccatacatccccagatgtggacttgggagatatttcaggcatcaatgccagtgtcgttaacattcagaaggaaatagaccggctgaatgaggtggctaaaaacttaaacgaaagcctcatcgacctgcaggagcttggtaagtatgagcagtacattaaatggccctggtatatctggctggggttcattgcaggactaatcgccatagtgatggtcaccatcatgctctgctgtatgacttcttgctgttcctgcctgaagggctgttgctcatgtggtagttgctgcaaatttgatgaagacgatagcgagcctgtgttgaagggcgttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12481 - RNA, 4094 nt, synthetic construct
  misc_feature 1..4094: note = SARS-CoV-2/Germany/BavPat1/2020__EPI_ISL_406862 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctaagctccacagcctcagcactgggcaaactccaggacgtcgttaatcagaacgcgcaggccctgaatactcttgtgaagcaattgagcagtaactttggtgctatctcttccgtactgaatgacatattaagccgactcgataaggtggaagccgaggtccagatcgacagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggatttctgtggcaaaggttaccacctaatgtcctttccccaaagcgcgccacatggcgtcgtgttcctgcacgttacttatgtgccggcccaggagaagaattttaccacagctcctgcaatctgccacgacgggaaagcccatttccccagggaaggagtctttgtatctaacggcactcactggttcgtgacccagcgcaatttttacgagccacagataattacaacggataacaccttcgttagcgggaattgtgacgtggtcatcggaatcgtgaacaatactgtatatgatcccctccaacctgagctggactccttcaaggaagaacttgataaatactttaagaaccatacatcaccagacgtggatttgggcgacattagtggtatcaatgccagcgtcgttaacattcagaaggaaatagatcgactgaatgaggtggctaaaaacttaaacgaatctctcatcgacctgcaggagcttgggaagtatgagcagtacattaaatggccctggtatatctggctgggattcattgcaggcctaatcgccatagtgatggtcaccatcatgctctgctgtatgacttcctgctgttcatgcctgaagggttgttgcagttgtggcagctgctgcaaatttgacgaagatgactccgagcctgtgttgaagggggttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12482 - RNA, 4094 nt, synthetic construct
  misc_feature 1..4094: note = SARS-CoV-2/Wuhan/HBCDC-HB-02/2020__EPI_ISL_412978 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaattttctgttgcaatacggcagcttctgcacccagctcaacagagccctgactggaatcgcagtggagcaggataaaaatacacaggaagtttttgcgcaagtgaagcagatttataaaaccccgcctatcaaggacttcgggggatttaacttctcgcagattttaccagatccctccaaaccttctaagaggagctttatcgaggacctgctattcaataaggtaactctcgctgatgccggtttcataaaacaatacggcgactgtctgggggatatcgcagcccgtgaccttatttgcgctcagaagtttaacggattgaccgtcctgcccccactcctgacagatgaaatgatcgcccagtatacgtcagcattactggctggcaccattacgagtggttggacattcggggccggcgcggcccttcagatcccttttgctatgcaaatggcataccggttcaatggaataggcgtgacccagaacgtgttgtatgagaatcagaaactcattgccaaccagtttaactccgctatcgggaagattcaagactctctgagctccacagcctcagcactaggaaaactgcaggacgtcgttaatcagaacgcgcaggccctcaatactctggtgaagcaacttagcagtaacttcggcgctatctcttccgtattgaatgatatactgagccgattagacaaggtggaagccgaggtccagatcgatagactcattaccggtaggctgcagtcgcttcaaacgtacgtgacacagcagctgatccgcgcagctgagattcgggcctcagcaaacttggccgctaccaaaatgtctgaatgcgttctcgggcagagtaagagagtggacttttgtggaaaaggctaccacctgatgtccttcccccaaagcgcgccacatggtgtcgtgtttctacacgttacttatgtgccggcccaggagaagaatttcaccacagctcctgcaatctgccacgatggcaaagcccattttcccagggaaggggtcttcgtatctaacggaactcactggtttgtgacccagcgcaatttctacgagccacagataattacaacggacaacaccttcgttagcggcaattgtgatgtggtcatcgggatcgtgaacaatactgtatatgaccccctgcaacctgagctcgattcctttaaggaagaactggacaaatacttcaagaaccatacatcaccagatgtggaccttggagatattagtggcatcaatgccagcgtcgttaacattcagaaggaaatagaccgattgaatgaggtggctaaaaacctgaacgaatctttaatcgacctccaggagctgggtaagtatgagcagtacattaaatggccctggtatatctggcttgggtttattgcaggactgatcgccatagtgatggtcaccatcatgctatgctgtatgacttcctgctgttcatgcctcaagggctgttgcagttgtggtagctgctgcaaattcgatgaagacgattccgagcctgtgctgaagggcgttaagttgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12483 - RNA, 4094 nt, synthetic construct
  misc_feature 1..4094: note = SARS-CoV-2/Australia/QLD02/2020__EPI_ISL_407896 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcgttagcggcaattgtgatgtggtcatcgggatcgtgaacaatactgtatatgaccccctccaactggagcttgattccttcaaggaagagttggacaaatactttaagaaccatacatcacctgatgtggacctgggagatattagtggcatcaatgccagcgtcgttaacattcagaaggaaatagaccgattaaatgaggtggctaaaaacctcaacgaatctctgatcgaccttcaggagctgggtaagtatgagcagtacattaaatggccatggtatatctggctagggttcattgcaggactcatcgccatagtgatggtcaccatcatgctgtgctgtatgacttcctgctgttcatgcttgaagggctgttgcagttgtggtagctgctgcaaatttgatgaagacgattccgagcccgtgctgaagggcgttaagttacactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12484 - RNA, 4094 nt, synthetic construct
  misc_feature 1..4094: note = SARS-CoV-2/India/1-31/2020__EPI_ISL_413523 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgtcatcgggaagattcaagactctctaagctccacagcttcagccctgggaaaactccaggacgttgtgaatcagaacgcacaggcgctgaatactcttgtaaagcaattgagcagtaactttggcgccatctcttccgtgctgaatgatatattaagccgactcgacaaggtcgaagctgaggtgcagatcgatagactgattaccggtaggcttcagtcgctgcaaacgtacgttacacagcagttgatccgcgccgcagagattcgggcttcagccaacctcgcagccaccaaaatgtctgaatgcgtgctggggcagagtaagagagtcgacttctgtggaaaaggctaccacctaatgtcctttccccaaagcgctccacatggtgtggttttcctgcacgtgacttatgtcccggcgcaggagaagaattttaccacagcccctgcaatctgccacgatggcaaagctcatttccccagggaaggggtatttgtgtctaacggaactcactggttcgttacccagcgcaatttttacgagccacagataattacaacggacaacaccttcgtgagcggcaattgtgatgtcgtgatcgggatcgtaaacaatactgtgtatgaccccctccaacctgagctggattccttcaaggaggaacttgacaaatactttaagaaccatacatcaccagatgtcgacttgggagatattagtggcatcaatgccagcgttgtgaacattcagaaggaaatagaccgactgaatgaggtggccaaaaacttaaacgaatctctcatcgacctgcaggagcttggtaagtatgagcagtacattaaatggccctggtatatctggctggggttcattgctggactaatcgcaatagtcatggtgaccatcatgctctgctgtatgacttcctgctgttcatgcctgaagggctgttgcagttgtggtagctgctgcaaatttgatgaagacgattccgagcctgttttgaagggcgtaaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12485 - RNA, 4094 nt, synthetic construct
  misc_feature 1..4094: note SARS-CoV-2/Guangdong/GD2020087-P0008/2020__EPI_ISL_413863 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggaatctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcgggagatcgcacccgggcagacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgaaagagatatatccaccgagatctaccaagcgggaagcacaccctgtaacggtgttgaaggcttcaattgctactttccactgcagtcttatgggttccagcctaccaacggagtgggctaccaaccctatagggtagtcgtgttgtcatttgagctcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacagaccctggaaatccttgacataactccgtgctccttcgggggagtgtctgttattacacccggtacgaatacctcgaaccaagtcgctgtgttgtaccaggacgtgaattgtactgaggtccctgttgccatccacgcagatcagctgacaccaacctggcgcgtgtatagcacaggctccaacgtgtttcagactagagccgggtgcctcatcggagctgaacatgtaaacaattcatacgagtgtgacattcccatcggcgcgggtatttgcgcaagttatcaaacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagagattcttcccgtgtctatgactaagacctccgtcgattgtacgatgtatatatgcggcgactcaacagagtgtagtaatctgttgctccagtacggcagcttttgcacccaactgaacagagccttaactggaatcgcagtggaacaggataaaaatacacaggaggttttcgcacaggtgaagcaaatttataaaaccccgcctatcaaggactttgggggattcaacttttcgcagattctgccagatccctccaaaccttctaagaggagcttcatcgaagacctactctttaataaggtaactctggctgatgccggtttcataaaacagtacggcgactgtcttggggatatcgcagcccgtgacttgatttgcgctcaaaagttcaacggactgaccgtcctgcccccactcttaacagatgagatgatcgcccagtatacgtcagcactgcttgctggcaccattacgagtggttggacatttggggccggcgcggccttgcagatccctttcgctatgcagatggcataccggtttaatggaataggcgtgacccaaaacgtgctctatgaaaatcagaaactgattgccaaccagttcaactccgctatcgggaagattcaggactctctaagctccacagcctcagcactgggaaaactccaagacgtcgttaatcagaacgcgcaggccctgaatactcttgtgaagcagttgagcagtaactttggcgctatctcttccgtactgaatgatatattaagccgactcgacaaggtggaggccgaggtccaaatcgatagactgattaccggtaggcttcagtcgctgcagacgtacgtgacacaacagttgatccgcgcagctgaaattcgggcctcagcaaacctcgccgctaccaaaatgtctgagtgcgttctggggcagagtaagagagtggacttctgtggaaaaggctaccacctaatgtcctttccccagagcgcgccacatggtgtcgtgttcctgcacgttacttatgtgccggcccaagaaaagaattttaccacagcgcctgctatctgccacgatggcaaagcccatttccccagggagggggtctttgtatctaacggaactcactggttcgtgacccagcgcaatttttacgagccacagataattacaacggacaacaccttcgttagcggcaattgtgatgtggtcatcgggatcgtgaacaatactgtatatgaccccctccagcctgaactggattccttcaaggaggaacttgacaaatactttaagaaccatacatcaccagatgtggacttgggagatattagtggcatcaatgccagcgtcgttaacattcaaaaggagatagaccgactgaatgaagtggctaaaaacttaaacgagtctctcatcgacctgcaggagcttggtaagtatgaacagtacattaaatggccctggtatatctggctggggttcattgcaggactaatcgccatagtgatggtcaccatcatgctctgctgtatgacttcctgctgttcatgcctgaagggctgttgcagttgtggtagctgctgcaaatttgatgaggacgattccgaacctgtgttgaagggcgttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12486 - RNA, 4094 nt, synthetic construct
  misc_feature 1..4094: note = SARS-CoV-2/Sweden/01/2020__EPI_ISL_411951 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactgtgggggatttaacttctcgcagattctgccagatccctccaaaccttctaagaggagctttatcgaggacctactcttcaataaggtaactctggctgatgccggttttataaaacaatacggcgactgccttggggatatcgcagcccgtgacttgatttgcgctcagaagttcaacggactgaccgtcctgcccccactcttaacagatgaaatgatcgcccagtatacgtcagcactgcttgctggcaccattacgagtggttggacattcggggccggcgcggccttgcagatcccttttgctatgcaaatggcataccggttcaatggaataggcgtgacccagaacgtgctctatgagaatcagaaactgattgccaaccagtttaactccgctatcgggaagattcaagactctctaagctccacagcctcagcactgggaaaactccaggacgtcgttaatcagaacgcgcaggccctgaatactcttgtgaagcaattgagcagtaacttcggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgtgttctggggcagagtaagagagtggacttttgcggaaaaggctaccacctaatgtccttcccccaaagcgcgccacatggtgtcgtgtttctgcacgttacttatgtgccggcccaggagaagaatttcaccacagctcctgcaatctgtcacgatggcaaagcccattttcccagggaaggggtcttcgtatctaacggaactcactggtttgtgacccagcgcaatttctacgagccacagataattacaacggacaacacctttgttagcggcaattgcgatgtggtcatcgggatcgtgaacaatactgtatatgaccccctccaacctgagctggattccttcaaggaggaacttgacaaatacttcaagaaccatacatcaccagatgtggacttgggagatattagtggcatcaatgccagcgtcgttaacattcagaaggaaatagaccgactgaatgaggtggctaaaaacttaaacgaatctctcatcgacctgcaggagcttggtaagtatgagcagtacattaaatggccctggtatatctggctggggtttattgcaggactaatcgccatagtgatggtcaccatcatgctctgttgcatgacttcctgttgctcatgtctgaagggctgctgtagttgcggtagctgctgtaaattcgatgaagacgattccgagcctgtgttgaagggcgttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12487 - RNA, 4094 nt, synthetic construct
  misc_feature 1..4094: note = SARS-CoV-2/Tianmen/HBCDC-HB-07/2020__EPI_ISL_412983 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacctgaattgtactgaagtgcctgtcgccatccacgcagatcagctcacaccaacctggcgcgtttatagcacaggctccaacgtgtttcaaactagagccgggtgcctgatcggagctgagcatgtgaacaattcatacgaatgtgacattcccatcggcgcgggtatttgcgcaagttatcagacccagacgaactctcctaggcgggcccgcagcgtagcttcccagtcaataatcgcctacaccatgagccttggggcagaaaattctgtcgcctactccaacaatagtattgctatcccaacaaacttcactatcagcgtgaccacagaaattctgcccgtttctatgactaagacctccgtggattgtacgatgtatatatgcggcgactcaacagagtgtagtaatttgctcctgcaatacggcagcttttgcacccagttaaacagagccctgactggaatcgcagtcgagcaggataaaaatacacaggaagtgttcgcgcaagttaagcagatttataaaaccccgcctatcaaggactttgggggattcaacttttcgcagattctaccagatccctccaaaccttctaagaggagcttcatcgaggacctcctgtttaataaggtgactcttgctgatgccggtttcataaaacaatacggcgactgtttgggggatatcgcagcccgtgacctgatttgcgctcagaagttcaacggactcaccgtactgcccccattactgacagatgaaatgatcgcccagtatacgtcagcacttttggctggcaccattacgagtggttggacatttggggccggcgcggccctccagatccctttcgctatgcaaatggcataccggtttaatggaataggcgtcacccagaacgtgctgtatgagaatcagaaactaattgccaaccagttcaactccgctatcgggaagattcaagactctctgagctccacagcctcagcactcggaaaactgcaggacgtggtcaatcagaacgcgcaggcccttaatactttggttaagcaactgagcagtaactttggcgctatctcttccgtgttaaatgatatactcagccgactggacaaggtagaagccgaggtgcagatcgatagacttattaccggtaggctgcagtcgttgcaaacgtacgtcacacagcagctcatccgcgcagctgagattcgggcctcagcaaacctggccgctaccaaaatgtctgaatgcgtgctagggcagagtaagagagttgacttctgtggaaaaggctaccacctgatgtcctttccccaaagcgcgccacatggtgtggtcttcctccacgtgacttatgttccggcccaggagaagaattttaccacagctcctgcaatctgccacgatggcaaagcccatttccccagggaaggggtgtttgtctctaacggaactcactggttcgtaacccagcgcaatttttacgagccacagataattacaacggacaacaccttcgtgagcggcaattgtgatgttgtgatcgggatcgtcaacaatactgtgtatgaccccctgcaacctgagcttgattccttcaaggaagagttggacaaatactttaagaaccatacatcaccagatgtagacctgggagatattagtggcatcaatgccagcgtggtcaacattcagaaggaaatagaccgattaaatgaggttgctaaaaacctcaacgaatctctgatcgaccttcaggagctgggtaagtatgagcagtacattaaatggccctggtatatctggctagggttcattgcaggactcatcgccatagtgatggtgaccatcatgctgtgctgtatgacttcctgctgttcatgcttgaagggctgttgcagttgtggtagctgctgcaaatttgatgaagacgattccgagcctgtcctgaagggcgtgaagttacactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12488 - RNA, 4094 nt, synthetic construct
  misc_feature 1..4094: note = SARS-CoV-2/Hong Kong/case42_VM20002493/2020__EPI_ISL_414527 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacacgaatagcttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcgccatcagcgttactaccgaaattcttcccgtgtctatgacaaagacttccgtcgattgtaccatgtatatatgcggcgactcaacggagtgtagtaatctgttgctccaatacggatctttttgcacacagctgaacagagcattaaccggcatcgcggtggagcaggataaaaatactcaggaagttttcgctcaagtgaagcagatttataaaacaccgcctatcaaggactttgggggattcaacttttcgcagattctgccagatccctccaaaccttctaagaggagcttcatcgaggacctactctttaataaggtaaccctggccgatgcaggtttcataaaacaatacggcgactgtcttggggatatcgccgctcgtgacttgatttgcgcccagaagttcaacggactgactgtcctgcccccactcttaaccgatgaaatgatcgcacagtatacatcagctctgcttgccggcacgattaccagtggttggacttttggggcgggcgccgctttgcagatccctttcgcaatgcaaatggcctaccggtttaatggaataggcgtgacacagaacgtgctctatgagaatcagaaactgattgctaaccagttcaactccgccatcgggaagattcaagactctctaagctccaccgcatcagcgctgggaaaactccaggacgtcgttaatcagaacgcccaggctctgaatacacttgtgaagcaattgagcagtaactttggcgccatctcttccgtactgaatgatatattaagccgactcgacaaggtggaagcagaggtccagatcgatagactgattactggtaggcttcagtcgctgcaaacctacgtgacgcagcagttgatccgcgctgccgagattcgggcatcagccaacctcgctgcgacaaaaatgtctgaatgcgttctggggcagagtaagagagtggacttctgtggaaaaggctaccacctaatgtcctttccccaaagcgccccacatggtgtcgtgttcctgcacgttacctatgtgccggcacaggagaagaattttactaccgctcctgccatctgccacgatggcaaagcccatttccccagggaaggggtctttgtatctaacggaacacactggttcgtgactcagcgcaatttttacgagccacagataattaccacagacaacacgttcgttagcggcaattgtgatgtggtcatcgggatcgtgaacaataccgtatatgaccccctccaacctgagctggattccttcaaggaggaacttgacaaatactttaagaaccatacttcaccagatgtggacttgggagatattagtggcatcaatgctagcgtcgttaacattcagaaggaaatagaccgactgaatgaggtggccaaaaacttaaacgaatctctcatcgacctgcaggagcttggtaagtatgagcagtacattaaatggccctggtatatctggctggggttcattgcaggactaatcgcgatagtgatggtcacaatcatgctctgctgtatgacctcctgctgttcatgcctgaagggctgttgcagttgtggtagctgctgcaaatttgatgaagacgattccgagcctgtgttgaagggcgttaagctgcactacacttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12489 - RNA, 4094 nt, synthetic construct
  misc_feature 1..4094: note = SARS-CoV-2/USA/CruiseA-23/2020__EPI_ISL_414482 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaagtcaagcagggcaattttaaaaacctcagagagttcgtttttaagaacattgatggttacttcaaaatctacagtaagcacaccccaataaatttagtgagggacctgccccaggggtttagcgctcttgagcctttggtagatctgccaatcggaattaacatcacacggttccagactctactcgccctgcatcgctcttatcttaccccgggcgactcctcaagcggctggacagcaggggccgctgcatactatgtgggatacctgcaacccagaacctttttgctcaaatataatgaaaacggtacgattactgatgccgtcgactgcgctctggatcctttaagtgagacaaagtgtaccctgaagtctttcactgtggaaaaaggcatctaccagacatccaattttagggttcagccaaccgagagcatagtgcggttccccaacattacgaatctctgcccttttggggaggtcttcaacgccacccgcttcgcgtcggtgtatgcatggaatcgaaagagaatctctaactgtgtagccgactactccgttctttacaattcagctagttttagcacattcaaatgctatggagtgtccccaactaagctgaacgacttgtgttttaccaatgtctacgccgattctttcgtgattaggggcgacgaagtccggcagatcgcacccggtcaaacagggaaaatcgctgattataactacaagctaccggacgattttactggatgcgtgattgcctggaatagcaacaacctggactcaaaagttggcggcaattataactacctctatcgtctgttccgcaagagtaatcttaagccttttgagagagatatatccaccgaaatctaccaggcggggagcacaccctgtaacggagtggagggtttcaattgctactttccactgcagtcttatggcttccaacctaccaacggggtaggataccagccctatagggtcgtggttttgtcatttgaactcctgcacgccccagcaactgtgtgcggccccaaaaagagtacgaatttagtcaaaaacaagtgtgtgaatttcaactttaatggtctgacagggaccggcgtactaactgagagcaacaaaaagttcctccctttccagcagtttggacgggacattgctgataccacagacgccgtgcgagatccacaaaccctggagatccttgacataactccgtgctccttcggcggggtttctgtcattacacccggaacgaatacctcgaaccaggtggctgtgttgtaccaggacgtcaattgtactgaagttcctgtggccatccacgcagatcagctgacaccaacctggcgcgtgtatagcacaggttccaacgtatttcaaactagagccggctgcctcatcggggctgagcatgtcaacaattcatacgaatgtgacattcccatcggagcgggcatttgcgcaagttatcagacccagacgaactctcctaggcgggcccgcagcgtggcttcccagtcaataatcgcctacaccatgagcctgggtgcagaaaattctgttgcctactccaacaatagtattgctatcccaacaaacttcactatcagcgtgaccacagaaattcttcccgtctctatgactaagacctccgtggattgtacgatgtatatatgcggggactcaacagagtgtagtaatctgttgctccaatacggcagcttttgcacccagctgaacagagccttaactggaatcgcagttgagcaggataaaaatacacaggaagtgttcgcgcaagtaaagcagatttataaaaccccgcctatcaaggactttggcgggttcaacttttcgcagattctgccagatccctccaaaccttctaagaggagcttcatcgaggacctactctttaataaggtcactctggctgatgccggattcataaaacaatacggtgactgtcttggcgatatcgcagcccgtgacttgatttgcgctcagaagttcaacgggctgaccgtgctgcccccactcttaacagatgaaatgatcgcccagtatacgtcagcactgcttgctggaaccattacgagtggctggacatttggtgccggggcggccttgcagatccctttcgctatgcaaatggcataccggtttaatggcataggagtgacccagaacgtcctctatgagaatcagaaactgattgccaaccagttcaactccgctatcggcaagattcaagactctctaagctccacagcctcagcactggggaaactccaggacgttgtgaatcagaacgcgcaggccctgaatactcttgtaaagcaattgagcagtaactttggagctatctcttccgtgctgaatgatatattaagccgactcgacaaggtcgaagccgaggtgcagatcgatagactgattaccggcaggcttcagtcgctgcaaacgtacgttacacagcagttgatccgcgcagctgagattcgggcctcagcaaacctcgccgctaccaaaatgtctgaatgcgtgctgggtcagagtaagagagtcgacttctgtgggaaaggataccacctaatgtcctttccccaaagcgcgccacatggcgtggttttcctgcacgtgacttatgtcccggcccaggagaagaattttaccacagctcctgcaatctgccacgatggtaaagcccatttccccagggaaggcgtatttgtgtctaacgggactcactggttcgttacccagcgcaatttttacgagccacagataattacaacggacaacaccttcgtgagcggaaattgtgatgtcgtgatcggcatcgtaaacaatactgtgtatgaccccctccaacctgagctggattccttcaaggaagaacttgacaaatactttaagaaccatacatcaccagatgtcgacttgggggatattagtggaatcaatgccagcgttgtgaacattcagaaggaaatagaccgactgaatgaggtggctaaaaacttaaacgaatctctcatcgacctgcaggagcttggcaagtatgagcagtacattaaatggccctggtatatctggctgggtttcattgcagggctaatcgccatagtcatggtgaccatcatgctctgctgtatgacttcctgctgttcatgcctgaagggatgttgcagttgtggcagctgctgcaaatttgatgaagacgattccgagcctgttttgaagggtgtaaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12490 - RNA, 4094 nt, synthetic construct
  misc_feature 1..4094: note = SARS-CoV-2/Hong Kong/case85_VM20002868/2020__EPI_ISL_414519 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctcgttccccttgtgagctcccagtgcgtaaacctgaccacaagaactcaattgcctccagcctacactaattctttcaccaggggcgtgtattacccggacaaggtctttcggtcaagtgtgttacacagcacacaggatctgttcctaccctttttctccaacgttacttggtttcatgctatccacgtgtctgggaccaatggaacaaaacgcttcgacaaccctgtcctcccatttaatgatggtgtgtatttcgcatcgaccgagaagtcaaacattatacgaggctggatctttgggactacactggacagcaaaacccagagtcttctgattgtaaataacgccacgaatgttgtgatcaaggtctgtgagttccagttttgcaacgatcccttcttgggagtgtactatcataaaaataacaagtcctggatggagtctgagttccgtgtgtacagctccgcgaataactgtacttttgaatatgtctcacaacctttcctcatggacctggaaggcaagcagggtaattttaaaaacctgagagagttcgtttttaagaacattgatgggtacttcaaaatctacagtaagcacaccccaataaatctcgtgagggacttaccccagggatttagcgctctggagcctcttgtagatttgccaatcggcattaacatcacacggttccagactctgctagccctccatcgctcttatctgaccccgggcgactcctcaagcgggtggacagcaggagccgctgcatactatgtgggttaccttcaacccagaacctttctgttgaaatataatgaaaacggcacgattactgatgccgtcgactgcgctctcgatcctctgagtgagacaaagtgtaccttaaagtctttcactgtggaaaaagggatctaccagacatccaattttagggttcagccaaccgagagcatagtgcggttccccaacattacgaatctgtgcccttttggagaggtcttcaacgccacccgcttcgcgtcggtgtatgcatggaatcgaaagagaatctctaactgtgtagccgactactccgttctctacaattcagctagttttagcacattcaaatgctatggcgtgtccccaactaaacttaacgacctgtgttttaccaatgtctacgccgattctttcgtgattaggggtgacgaagtccggcagatcgcacccgggcaaacaggaaagatcgctgattataactacaagttgccggacgattttactggctgcgtgattgcctggaatagcaacaacctagactcaaaagttggcgggaattataactacctgtatcgtctcttccgcaagagtaatctgaagccttttgagagagatatatccaccgaaatctaccaggcgggaagcacaccctgtaacggtgtggagggcttcaattgctactttccacttcagtcttatgggttccaacctaccaacggagtaggctaccagccctatagggtcgtggttctgtcatttgaattgctccacgccccagcaactgtgtgcggtcccaaaaagagtacgaatctggtcaaaaacaagtgtgtgaatttcaactttaatgggttaacaggcaccggagtactgactgagagcaacaaaaagttcctacctttccagcagtttggccgggacattgctgataccacagacgccgtgcgagatccacaaaccctcgagatcctggacataactccgtgctccttcgggggagtttctgtcattacacccggtacgaatacctcgaaccaggtggctgtgctttaccaggacgtcaattgtactgaagttcctgtggccatccacgcagatcagttgacaccaacctggcgcgtgtatagcacaggctccaacgtatttcaaactagagccgggtgcctgatcggagctgagcatgtcaacaattcatacgaatgtgacattcccatcggcgcgggtatttgcgcaagttatcagacccagacgaactctcctaggcgggcccgcagcgtggcttcccagtcaataatcgcctacaccatgagcctcggggcagaaaattctgttgcctactccaacaatagtattgctatcccaacaaacttcactatcagcgtgaccacagaaattctgcccgtctctatgactaagacctccgtggattgtacgatgtatatatgcggcgactcaacagagtgtagtaatcttctgttgcaatacggcagcttttgcacccagctcaacagagccctgactggaatcgcagttgagcaggataaaaatacacaggaagtgttcgcgcaagtaaagcagatttataaaaccccgcctatcaaggactttgggggattcaacttttcgcagattttaccagatccctccaaaccttctaagaggagcttcatcgaggacctgctatttaataaggtcactctcgctgatgccggtttcataaaacaatacggcgactgtctgggggatatcgcagcccgtgaccttatttgcgctcagaagttcaacggattgaccgtgctgcccccactcctgacagatgaaatgatcgcccagtatacgtcagcattactggctggcaccattacgagtggttggacatttggggccggcgcggcccttcagatccctttcgctatgcaaatggcataccggtttaatggaataggcgtgacccagaacgtcttgtatgagaatcagaaactcattgccaaccagttcaactccgctatcgggaagattcaagactctctgagctccacagcctcagcactaggaaaactgcaggacgttgtgaatcagaacgcgcaggccctcaatactctggtaaagcaacttagcagtaactttggcgctatctcttccgtgttgaatgatatactgagccgattagacaaggtcgaagccgaggtgcagatcgatagactcattaccggtaggctgcagtcgcttcaaacgtacgttacacagcagctgatccgcgcagctgagattcgggcctcagcaaacttggccgctaccaaaatgtctgaatgcgtgctcgggcagagtaagagagtcgacttctgtggaaaaggctaccacctgatgtcctttccccaaagcgcgccacatggtgtggttttcctacacgtgacttatgtcccggcccaggagaagaattttaccacagctcctgcaatctgccacgatggcaaagcccatttccccagggaaggggtatttgtgtctaacggaactcactggttcgttacccagcgcaatttttacgagccacagataattacaacggacaacaccttcgtgagcggcaattgtgatgtcgtgatcgggatcgtaaacaatactgtgtatgaccccctgcaacctgagctcgattccttcaaggaggaactggacaaatactttaagaaccatacatcaccagatgtcgaccttggagatattagtggcatcaatgccagcgttgtgaacattcagaaggaaatagaccgattgaatgaggtggctaaaaacctgaacgaatctttaatcgacctccaggagctgggtaagtatgagcagtacattaaatggccctggtatatctggcttgggttcattgcaggactgatcgccatagtcatggtgaccatcatgctatgctgtatgacttcctgctgttcatgcctcaagggctgttgcagttgtggtagctgctgcaaatttgatgaagacgattccgagcctgttctgaagggcgtaaagttgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12491 - RNA, 4094 nt, synthetic construct
  misc_feature 1..4094: note = SARS-CoV-2/England/200990660/2020__EPI_ISL_414523 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctaagctccacagcctcagcactgggcaaactccaggacgtcgttaatcagaacgcgcaggccctgaatactcttgtgaagcaattgagcagtaactttggtgctatctcttccgtactgaatgacatattaagccgactcgataaggtggaagccgaggtccagatcgacagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggatttctgtggcaaaggttaccacctaatgtcctttccccaaagcgcgccacatggcgtcgtgttcctgcacgttacttatgtgccggcccaggagaagaattttaccacagctcctgcaatctgccacgacgggaaagcccatttccccagggaaggagtctttgtatctaacggcactcactggttcgtgacccagcgcaatttttacgagccacagataattacaacggataacaccttcgttagcgggaattgtgacgtggtcatcggaatcgtgaacaatactgtatatgatcccctccaacctgagctggactccttcaaggaagaacttgataaatactttaagaaccatacatcaccagacgtggatttgggcgacattagtggtatcaatgccagcgtcgttaacattcagaaggaaatagatcgactgaatgaggtggctaaaaacttaaacgaatctctcatcgacctgcaggagcttgggaagtatgagcagtacattaaatggccctggtatatctggctgggattcattgcaggcctaatcgccatagtgatggtcaccatcatgctctgctgtatgacttcctgctgttcatgcctgaagggttgttgcagttgtggcagctgctgcaaatttgacgaagatgactccgagttggtgctgaagggggttaagttacactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12492 - RNA, 4094 nt, synthetic construct
  misc_feature 1..4094: note = SARS-CoV-2/Australia/NSW09/2020__EPI_ISL_413595 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctacccccactgttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctcagctttacagcctccgcactgggaaaactccaggacgtcgttaatcagaacgcgcaggccctgaatactcttgtgaagcaattgtcaagcaacttcggcgctatcagttctgtactgaatgatatattatcccgactcgacaaggtggaagccgaggtccagatcgatagactgattaccggtaggcttcagagcctgcaaacgtacgtgacacagcagttgatccgcgcagctgagattcgggcctcggcaaacctcgccgctaccaaaatgtcagaatgcgttctggggcagtctaagagagtggacttttgtggaaaaggctaccacctaatgagtttcccccaatccgcgccacatggtgtcgtgtttctgcacgttacttatgtgccggcccaggagaagaatttcaccacagctcctgcaatctgccacgatggcaaagcccattttcccagggaaggggtcttcgtaagcaacggaactcactggtttgtgacccagcgcaatttctacgagccacagataattacaacggacaacaccttcgtttctggcaattgtgatgtggtcatcgggatcgtgaacaatactgtatatgaccccctccaacctgagctggatagctttaaggaggaacttgacaaatacttcaagaaccatacatccccagatgtggacttgggagatatttcaggcatcaatgccagtgtcgttaacattcagaaggaaatagaccgactgaatgaggtggctaaaaacttaaacgaaagcctcatcgacctgcaggagcttggtaagtatgagcagtacattaaatggccctggtatatctggctggggtttattgcaggactaatcgccatagtgatggtcaccatcatgctctgctgtatgacttcttgctgttcctgcctgaagggctgttgctcatgtggtagttgctgcaaattcgatgaagacgatagcgagcctgtgttgaagggcgttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12493 - RNA, 4094 nt, synthetic construct
  misc_feature 1..4094: note = SARS-CoV-2/Australia/NSW10/2020__EPI_ISL_413596 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcgttagcggcaattgtgatgtggtcatcgggatcgtgaacaatactgtatatgaccccctccaacctgagctggattccttcaaggaggaacttgacaaatactttaagaaccatacatcaccagatgtggacttgggagatattagtggcatcaatgccagcgtcgttaacattcagaaggaaatagaccgactgaatgaggtggctaaaaacttaaacgaatctctcatcgacctgcaggagcttggtaagtatgagcagtacattaaatggccctggtatatctggctggggttcattgcaggactaatcgccatagtgatggtcaccatcatgctctgctgtatgacttcctgctgttcatgcctgaagggctgttgcagttgtggtagctgctttaaattcgatgaagacgattccgagcctgtgttgaagggcgttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12494 - RNA, 4094 nt, synthetic construct
  misc_feature 1..4094: note SARS-CoV-2/Switzerland/1000477797/2020__EPI_ISL_413023 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaatatctacagtaaacacaccccaataaacttagttagggacctgccccagggatttagcgctcttgagcctttggtggatctgccaatcggcattaatatcacacggttccagactctactcgccctgcatcgctcttatcttaccccgggcgactcctcaagcgggtggacagcaggagccgctgcatactatgtaggttacctgcaacccagaacctttttgctcaagtataacgaaaatggcacgattactgatgccgtggactgcgctctggatcctttaagtgagacaaaatgtaccctgaagtctttcactgtcgaaaaggggatctaccagacatccaactttagggtgcagccaaccgagagcatagttcggttccccaatattacgaacctctgcccttttggagaggtgttcaatgccacccgcttcgcgtcggtctatgcatggaaccgaaaaagaatctctaattgtgtggccgactactccgtactttacaactcagctagttttagcacattcaagtgctatggcgtttccccaactaaactgaatgacttgtgttttaccaacgtgtacgccgattctttcgtcattaggggtgacgaagtgcggcagatcgcacccgggcaaacaggaaagatcgctgattataattacaaactaccggacgattttactggctgcgtcattgcctggaacagcaacaatctggactcaaaggtgggcgggaactataattacctctatcgtctgttccgcaaaagtaaccttaagccttttgagagagatatatccaccgaaatctaccaggcgggaagcacaccctgtaatggtgttgagggcttcaactgctactttccactgcagtcttatgggttccaacctaccaatggagtgggctaccagccctatagggtagtcgtgttgtcatttgaactcctgcacgccccagcaactgtttgcggtcccaagaaaagtacgaacttagtgaagaataaatgtgtcaacttcaattttaacgggctgacaggcaccggagtgctaactgagagcaataagaaattcctccctttccagcagtttggccgggacattgctgataccacagacgccgtacgagatccacaaaccctggagatccttgacataactccgtgctccttcgggggagtgtctgttattacacccggtacgaacacctcgaatcaggtcgctgtgttgtaccagggcgtgaactgtactgaagtccctgttgccatccacgcagaccagctgacaccaacctggcgcgtgtatagcacagggtccaacgtgtttcaaactagagccggatgcctcatcggcgctgagcatgtaaataactcatacgaatgtgatattcccatcggtgcggggatttgcgcaagttatcagacccagaccaattctcctaggcgggcccgcagcgtcgcttcccagtcaataatcgcctacacgatgagcctgggcgcagagaactctgtggcctactccaataacagtattgctatcccaacaaatttcactatcagcgttaccacagaaattcttcccgtgtctatgactaagacctccgtcgactgtacgatgtatatatgcggagattcaacagagtgtagtaacctgttgctccaatacggcagcttttgcacccagctgaatagagccttaactgggatcgcagtggagcaggacaagaacacacaggaagttttcgcgcaagtgaaacagatttataagaccccgcctatcaaagattttggaggtttcaatttttcgcagattctgccagacccctccaagccttctaaaaggagcttcatcgaggatctactctttaacaaggtaactctggctgacgccggcttcataaagcaatacggggattgtcttggagacatcgcagcccgtgatttgatttgcgctcagaaattcaatggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaacggcataggggtgacccagaatgtgctctatgagaaccagaagctgattgccaaccagttcaattccgctatcggaaaaattcaagattctctaagctccacagcctcagcactgggcaagctccaggacgtcgttaaccagaatgcgcaggccctgaacactcttgtgaaacaattgagcagtaattttggtgctatctcttccgtactgaacgacatattaagccgactcgataaggtggaagccgaggtccagatcgacagactgattaccgggaggcttcagtcgctgcaaacgtacgtgacacagcagttgatccgcgcagctgagattcgggcctcagcaaatctcgccgctaccaagatgtctgaatgcgttctgggacagagtaaaagagtggatttctgtggcaagggttaccacctaatgtcctttccccaaagcgcgccacatggcgtcgtgttcctgcacgttacttatgtgccggcccaggagaaaaactttaccacagctcctgcaatctgccacgacgggaaggcccatttccccagggaaggagtctttgtatctaatggcactcactggttcgtgacccagcgcaacttttacgagccacagataattacaacggataataccttcgttagcgggaactgtgacgtggtcatcggaatcgtgaataacactgtatatgatcccctccaacctgagctggactccttcaaagaagaacttgataagtactttaaaaatcatacatcaccagacgtggatttgggcgacattagtggtatcaacgccagcgtcgttaatattcagaaggaaatagatcgactgaacgaggtggctaagaacttaaatgaatctctcatcgacctgcaggagcttgggaaatatgagcagtacattaagtggccctggtatatctggctgggattcattgcaggcctaatcgccatagtgatggtcaccatcatgctctgctgtatgacttcctgctgttcatgcctgaaaggttgttgcagttgtggcagctgctgcaagtttgacgaagatgactccgagcctgtgttgaaaggggttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12495 - RNA, 4094 nt, synthetic construct
  misc_feature 1..4094: note = SARS-CoV-2/Belgium/BA-02291/2020__EPI_ISL_415159 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcagaagtaatcttaagccttttgagagggatatatccaccgaaatctaccaggcgggaagcacaccctgtaacggtgttgagggcttcaattgctactttccactgcagtcttatgggttccaacctaccaacggagtgggctaccagccctatcgggtagtcgtgttgtcatttgaactcctgccagcccccgcaactgtttgcggtcctaagaaaagtacgaatttagtgaagaacaaatgtgtcaatttcaactttaatgggctgacaggcaccggagtgctaactgagagcaacaagaaattcctcccattccagcagtttggccgagacattgctgataccacagacgccgtacgcgatccgcaaaccctggagatccttgacataactccctgctccttcgggggagtgtctgttattacacctggtacgaatacctcgaaccaggtcgctgtgttgtaccagggcgtgaattgtactgaagtcccagttgccatccacgcagaccagctgacacccacctggagagtgtatagcacagggtccaacgtgtttcaaactagggccggatgcctcatcggcgctgagcacgtaaacaattcatacgaatgtgatattcctatcggtgcggggatttgcgcaagttatcagacccagacgaactctccacggcgcgccagaagcgtcgcttcccagtcaataatcgcctacaccatgagcctgggcgcagaaaattctgtggcctactccaacaatagtattgctatccccacaaacttcactatcagcgttaccacagaaattcttccggtgtctatgactaagacctccgtcgactgtacgatgtatatatgcggagattcaacagagtgtagtaatctgttgctccaatacggcagcttttgcacccagctgaacagggccttaactgggatcgcagtggagcaggacaagaatacacaggaagttttcgcgcaagtgaaacagatttataagacccctccaatcaaagattttggaggtttcaacttttcgcagattctgcccgacccttccaagccctctaaacgtagcttcatcgaggatctactctttaataaggtaactctggctgacgccggcttcataaagcaatacggggattgtcttggagacatcgcagcccgggatttgatttgcgctcagaaattcaacggcctgaccgtcctcccacctctgttaacagacgaaatgatcgcccagtatacgtcagcactgcttgctggtaccattacgagtgggtggacatttggcgccggagcggccttgcagatccccttcgctatgcaaatggcataccgatttaatggcataggggtgacccagaacgtgctctatgagaatcagaagctgattgccaaccagttcaactccgctatcggaaaaattcaagattctctaagctccgccgcaccagcgctgggcaagctccaggacgtcgttaatcagaacgcccaggctctgaatacacttgtgaaacaattgtcaagcaactttggtgccatcagttctgtactgaatgacatattatccagactcgataaggtggaagcagaggtccagatcgacaggctgattactgggcgccttcagagcctgcaaacctacgtgacgcagcagttgatccgggctgccgagattagagcatcggccaacctcgctgcgacaaagatgtcagaatgcgttctgggacagtctaaaagggtggatttctgtggcaagggttaccatctaatgagttttccgcaatccgcccctcacggcgtcgtgttcctgcatgttacctatgtgcccgcacaggagaaaaattttactaccgctccagccatctgccacgacgggaaggcccacttcccccgcgaaggagtctttgtaagcaacggcacacattggttcgtgactcagcgaaatttttacgagcctcagataattaccacagataacacgttcgtttctgggaattgtgacgtggtcatcggaatcgtgaacaataccgtatatgatccactccaacccgagctggacagcttcaaagaagaacttgataagtactttaaaaaccacacttcccctgacgtggatttgggcgacatttcaggtatcaatgctagtgtcgttaacattcagaaggaaatagatcggctgaatgaggtggcaaagaacttaaacgaaagcctcatcgacctgcaggagcttgggaaatatgagcagtacattaagtggccgtggtatatctggctgggattcattgccggcctaatcgcgatagtgatggtcacaatcatgctctgctgtatgacctcttgctgttcctgcctgaaaggttgttgctcatgtggcagttgctgcaagtttgacgaagatgacagcgagccagtgttgaaaggggttaagctgcattacacttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12496 - RNA, 4094 nt, synthetic construct
  misc_feature 1..4094: note = SARS-CoV-2/USA/WA8-UW5/2020__EPI_ISL_413486 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagtacgtaaacaattcatatgaatgtgacattcccatcggcgcgggtatttgcgcaagttaccagacccagacgaactctcctaggcgggcccgcagcgtcgcttcccagtcaataatcgcctacaccatgagcctgggggcagaaaattctgtggcctattccaacaatagtattgctatcccaacaaacttcactatcagcgttaccacagaaattcttcccgtgtctatgactaagacctccgtcgattgtacgatgtacatatgcggcgactcaacagagtgtagtaatctgttgctccaatatggcagcttttgcacccagctgaacagagccttaactggaatcgcagtggagcaggataaaaatacacaggaagttttcgcgcaagtgaagcagatttacaaaaccccgcctatcaaggactttgggggattcaacttttcgcagattctgccagatccctccaaaccttctaagaggagcttcatcgaggacctactctttaataaggtaactctggctgatgccggtttcataaaacaatatggcgactgtcttggggatatcgcagcccgtgacttgatttgcgctcagaagttcaacggactgaccgtcctgcccccactcttaacagatgaaatgatcgcccagtacacgtcagcactgcttgctggcaccattacgagtggttggacatttggggccggcgcggccttgcagatccctttcgctatgcaaatggcatatcggtttaatggaataggcgtgacccagaacgtgctctacgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctatcatctaatgtcctttccccaaagcgcgccacacggtgtcgtgttcctgcatgttacttacgtgccggcccaggagaagaattttaccacagctcctgcaatctgccacgatggcaaagcccacttccccagggaaggggtctttgtatctaacggaactcattggttcgtgacccagcgcaatttttatgagccacagataattacaacggacaacaccttcgttagcggcaattgtgatgtggtcatcgggatcgtgaacaatactgtatacgaccccctccaacctgagctggattccttcaaggaggaacttgacaaatattttaagaaccacacatcaccagatgtggacttgggagatattagtggcatcaatgccagcgtcgttaacattcagaaggaaatagaccgactgaatgaggtggctaaaaacttaaacgaatctctcatcgacctgcaggagcttggtaagtacgagcagtatattaaatggccctggtacatctggctggggttcattgcaggactaatcgccatagtgatggtcaccatcatgctctgctgtatgacttcctgctgttcatgcctgaagggctgttgcagttgtggtagctgctgcaaatttgatgaagacgattccgagcctgtgttgaagggcgttaagctgcattacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12497 - RNA, 4094 nt, synthetic construct
  misc_feature 1..4094: note = SARS-CoV-2/England/20102000506/2020__EPI_ISL_415147 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacgggtattgtcttggagatatcgcagcccgtgacttgatttgcgctcagaagttcaacggcctgaccgtcctgcccccactcttaacagatgaaatgatcgcccagtacacgtcagcactgcttgctggtaccattacgagtgggtggacatttggcgccggagcggccttgcagatccctttcgctatgcaaatggcatatcggtttaatggcataggggtgacccagaacgtgctctacgagaatcagaaactgattgccaaccagttcaactccgctatcggaaagattcaagactctctaagctccacagcctcagcactgggcaaactccaggatgtcgttaatcagaacgcgcaggccctgaatactcttgtgaagcaattgagcagtaactttggtgctatctcttccgtactgaatgacatattaagccgactcgacaaggtggaagccgaggtccagatcgatagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggacttctgtggcaaaggttatcacctaatgtcctttccccaaagcgcgccacatggcgtcgtgttcctgcacgttacttacgtgccggcccaggagaagaattttaccacagctcctgcaatctgccacgatgggaaagcccatttccccagggaaggagtctttgtatctaacggcactcactggttcgtgacccagcgcaatttttatgagccacagataattacaacggacaacaccttcgttagcgggaattgtgatgtggtcatcggaatcgtgaacaatactgtatacgaccccctccaacctgagctggattccttcaaggaagaacttgacaaatattttaagaaccatacatcaccagatgtggacttgggcgatattagtggtatcaatgccagcgtcgttaacattcagaaggaaatagaccgactgaatgaggtggctaaaaacttaaacgaatctctcatcgatctgcaggagcttgggaagtacgagcagtatattaaatggccctggtacatctggctgggattcattgcaggcctaatcgccatagtgatggtcaccatcatgctctgctgtatgacttcctgctgttcatgcctgaagggttgttgcagttgtggcagctgctgcaaatttgacgaagacgattccgagcctgtgttgaagggggttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12498 - RNA, 4094 nt, synthetic construct
  misc_feature 1..4094: note = SARS-CoV-2/Belgium/VAG-03013/2020__EPI_ISL_415155 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctaagctccacagccactgcactgggcaaactccaggacgtcgttaatcagaacgcgcaggccctgaatacccttgtgaagcaattgtcaagcaactttggtgctatcagttctgtactgaatgacatattatcccgactcgataaggtggaagccgaggtccagatcgacagactgattacggggaggcttcagagcctgcaaacatacgtgacccagcagttgatccgcgcagctgagattcgggcctcggcaaacctcgccgctactaaaatgtcagaatgcgttctgggacagtctaagagagtggatttctgtggcaaaggttaccacctaatgagttttccccaatccgcgccacatggcgtcgtgttcctgcacgttacctatgtgccggcccaggagaagaattttacaactgctcctgcaatctgccacgacgggaaagcccatttccccagggaaggagtctttgtaagcaacggcacccactggttcgtgacacagcgcaatttttacgagccacagataattacgaccgataacactttcgtttctgggaattgtgacgtggtcatcggaatcgtgaacaatacagtatatgatcccctccaacctgagctggacagcttcaaggaagaacttgataaatactttaagaaccatacctccccagacgtggatttgggcgacatttcaggtatcaatgccagtgtcgttaacattcagaaggaaatagatcgactgaatgaggtggctaaaaacttaaacgaaagcctcatcgacctgcaggagcttgggaagtatgagcagtacattaaatggccctggtatatctggctgggattcattgcaggcctaatcgccatagtgatggtcactatcatgctctgctgtatgacatcttgctgttcctgcctgaagggttgttgctcatgtggcagttgctgcaaatttgacgaagatgacagcgagcctgtgttgaagggggttaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12499 - RNA, 4094 nt, synthetic construct
  misc_feature 1..4094: note = SARS-CoV-2/Belgium/BC-03016/2020__EPI_ISL_415157 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctaagctccacagcccccgcactgggcaaactccaggacgtcgttaatcagaacgcgcaggccctgaatactcttgtgaagcaattgtcaagcaactttggtgctatcagttctgtactgaatgacatattatcccgactcgataaggtggaagccgaggtccagatcgacagactgattaccgggaggcttcagagcctgcaaacgtacgtgacacagcagttgatccgcgcagctgagattcgggcctcggcaaacctcgccgctaccaaaatgtcagaatgcgttctgggacagtctaagagagtggatttctgtggcaaaggttaccacctaatgagttttccacaatccgcgccgcatggcgtcgtgttcctgcacgttacttatgtgcctgcccaggagaagaattttaccacagcacccgctatctgccacgacgggaaagcccatttcccaagggaaggagtctttgtaagcaacggcactcactggttcgtgacccagcgcaatttttacgagccccagataattacaacggataacaccttcgtttctgggaattgtgacgtggtcatcggaatcgtgaacaatactgtatatgatcctctccaaccagagctggacagcttcaaggaagaacttgataaatactttaagaaccatacatcccccgacgtggatttgggcgacatttcaggtatcaatgccagtgtcgttaacattcagaaggaaatagatcgactgaatgaggtggctaaaaacttaaacgaaagcctcatcgacctgcaggagcttgggaagtatgagcagtacattaaatggccttggtatatctggctgggattcattgcaggcctaatcgccatagtgatggtcaccatcatgctctgctgtatgacttcttgctgttcctgcctgaagggttgttgctcatgtggcagttgctgcaaatttgacgaagatgacagcgagccggtgttgaagggggttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12500 - RNA, 4094 nt, synthetic construct
  misc_feature 1..4094: note = SARS-CoV-2/Germany/BavPat3/2020__EPI_ISL_414521 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacagcaagttttcgcacaggtgaagcagatttataaaaccccgcctatcaaggactttgggggattcaacttttcgcaaattctgccagatccctccaaaccttctaagaggagcttcatcgaagacctactctttaataaggtaactctggctgatgccggtttcataaaacagtacggcgactgtcttggggatatcgcagcccgtgacttgatttgcgctcagaagttcaacggactgaccgtcctgcccccactcttaacagatgagatgatcgcccagtatacgtcagcactgcttgctggcaccattacgagtggttggacatttggggccggcgcggccttgcaaatccctttcgctatgcagatggcataccggtttaatggaataggcgtgacccagaacgtgctctatgaaaatcagaaactgattgccaaccaattcaactccgctatcgggaagattcaggactctctaagctccacagcctcagcactgggaaaactccaggacgtcgttaatcagaacgcgcaagccctgaatactcttgtgaagcagttgagcagtaactttggcgctatctcttccgtactgaatgatatattaagccgactcgacaaggtggaggccgaagtccagatcgatagactgattaccggtaggcttcaatcgctgcagacgtacgtgacacagcagttgatccgcgcagctgagattcgggcctcagcaaacctcgccgctaccaaaatgtctgagtgcgttctggggcaaagtaagagagtggacttctgtggaaaaggctaccacctaatgtcctttccccagagcgcgccacatggtgtcgtgttcctgcacgttacttatgtgccggcccaggaaaagaattttaccacagcgcctgctatctgccacgatggcaaagcccatttccccagggagggggtctttgtatctaacggaactcactggttcgtgacccagcgcaatttttacgaaccacaaataattacaacggacaacaccttcgttagcggcaattgtgatgtggtcatcgggatcgtgaacaatactgtatatgaccccctccagcctgagctggattccttcaaggaggaacttgacaaatactttaagaaccatacatcaccagatgtggacttgggagatattagtggcatcaatgccagcgtcgttaacattcagaaggagatagaccgactgaatgaagtggctaaaaacttaaacgagtctctcatcgacctgcaggaacttggtaagtatgagcaatacattaaatggccctggtatatctggctggggttcattgcaggactaatcgccatagtgatggtcaccatcatgctctgctgtatgacttcctgctgttcatgcctgaagggctgttgcagttgtggtagctgctgcaaatttgatgaggacgattccgaacctgtgttgaagggcgttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12501 - RNA, 4094 nt, synthetic construct
  misc_feature 1..4094: note = SARS-CoV-2/France/HF1805/2020__EPI_ISL_414628 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctaagctccacagcctcagcactgggcaaactccaggacgtcgttaatcagaacgcgcaggccctgaatactcttgtgaagcaattgagcagtaactttggtgctatctcttccgtactgaatgacatattaagccgactcgataaggtggaagccgaggtccagatcgacagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggatttctgtggcaaaggttaccacctaatgtcctttccccaaagcgcgccacatggcgtcgtgttcctgcacgttacttatgtgccggcccaggagaagaattttaccacagctcctgcaatctgccacgacgggaaagcccatttccccagggaaggagtctttgtatctaacggcactcactggttcgtgacccagcgcaatttttacgagccacagataattacaacggataacaccttcgttagcgggaattgtgacgtggtcatcggagtggtaaacaatactgtgtatgatcccctccaacctgagctggactccttcaaggaagaacttgataaatactttaagaaccatacatcaccagacgtcgatttgggcgacatcagtggtattaatgccagcgttgtgaacatccagaaggaaattgatcgactgaatgaggtggctaaaaacttaaacgaatctctcatagacctgcaggagcttgggaagtatgagcagtacatcaaatggccctggtatatttggctgggattcatcgcaggcctaattgccatcgtcatggtgaccataatgctctgctgtatgacttcctgctgttcatgcctgaagggttgttgcagttgtggcagctgctgcaaatttgacgaagatgactccgagcctgttttgaagggggtaaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12502 - RNA, 4094 nt, synthetic construct
  misc_feature 1..4094: note SARS-CoV-2/Netherlands/ZuidHolland_9/2020__EPI_ISL_414445 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgtccagaagttcaacggcctgaccgtgctgcccccactcttaacagacgaaatgatcgctcagtatacgtcagccctgcttgcaggtaccattacgagtgggtggacatttggcgctggagccgcgttgcagatccctttcgccatgcaaatggcttaccggtttaatggcataggggtgacccagaacgtcctctatgagaatcagaaactgattgcaaaccagttcaactccgccatcggaaagattcaagattctctaagctccacagcttcagccctgggcaaactccaggacgttgtgaatcagaacgcacaggcgctgaatactcttgtaaagcaattgagcagtaactttggtgccatctcttccgtgctgaatgacatattaagccgactcgataaggtcgaagctgaggtgcagatcgacagactgattaccgggaggcttcagtcgctgcaaacgtacgttacacagcagttgatccgcgccgcagagattcgggcttcagccaacctcgcagccaccaaaatgtctgaatgcgtgctgggacagagtaagagagtcgatttctgtggcaaaggttaccacctaatgtcctttccccaaagcgctccacatggcgtggttttcctgcacgtgacttatgtcccggcgcaggagaagaattttaccacagcccctgcaatctgccacgacgggaaagctcatttccccagggaaggagtatttgtgtctaacggcactcactggttcgttacccagcgcaatttttacgagccacagataattacaacggataacaccttcgtgagcgggaattgtgacgtcgtgatcggaatcgtaaacaatactgtgtatgatcccctccaacctgagctggactccttcaaggaagaacttgataaatactttaagaaccatacatcaccagacgtcgatttgggcgacattagtggtatcaatgccagcgttgtgaacattcagaaggaaatagatcgactgaatgaggtggccaaaaacttaaacgaatctctcatcgacctgcaggagcttgggaagtatgagcagtacattaaatggccctggtatatctggctgggattcattgctggcctaatcgcaatagtcatggtgaccatcatgctctgctgtatgacttcctgctgttcatgcctgaagggttgttgcagttgtggcagctgctgcaaatttgacgaagatgactccgagcctgttttgaagggggtaaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12503 - RNA, 4094 nt, synthetic construct
  misc_feature 1..4094: note = SARS-CoV-2/Finland/FIN03032020A/2020__EPI_ISL_413602 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacaccaattctttcacgaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattagctggaactcaaataacctggacagtaaagtgggcgggaattataactacctctatcgtctgttccgcaagtccaatcttaagccttttgagagagatataagcaccgaaatctaccaggccggatctacaccctgtaacggtgttgagggcttcaattgctactttccactgcagtcatatgggttccaacctaccaacggagtgggctaccagccctatagggtagtcgtgttgagttttgaactcctgcacgcgccagccactgtttgcggtcccaaaaagagcacgaatttagtgaaaaacaagtgtgtcaatttcaactttaatgggctgacaggcaccggagtgctaactgagtccaacaaaaagttcctccctttccagcagtttggccgggacattgcagataccacagacgctgtacgagatccacaaaccctggagatccttgacataactccgtgctctttcgggggagtgtcggttattacacccggtacgaataccagcaaccaggtcgccgtgttgtaccagggcgtgaattgtactgaagtccctgttgctatccacgccgaccagctgacaccaacctggcgcgtgtattccacagggtcaaacgtgtttcaaactagagcaggatgcctcatcggcgccgagcatgtaaacaatagttacgaatgtgatattcccatcggtgctgggatttgcgcgtcttatcagacccagacgaacagccctaggcgggcacgctccgtcgcctcacagagcataatcgcttacaccatgtctctgggcgccgaaaattccgtggcatacagtaacaatagcattgccatcccaacaaacttcactatctctgttaccacagaaattcttcccgtgtccatgactaagacctcagtcgactgtacgatgtatatatgcggagatagtacagagtgtagcaatctgttgctccaatacggctcgttttgcacccagctgaacagagctttaactgggatcgccgtggagcaggacaaaaatacacaggaagttttcgcacaagtgaagcagatttataaaaccccgcctatcaaggattttggaggtttcaacttttcccagattctgccagacccctctaaacctagcaagaggtcattcatcgaggatctactctttaataaggtaactctggcggacgctggcttcataaaacaatacggggattgtcttggagacatcgccgcacgtgatttgatttgcgcccagaagttcaacggcctgaccgtcctgcccccactcttaacagacgaaatgatcgctcagtatacgagtgccctgcttgcaggtaccattacttccgggtggacatttggcgctggagccgcgttgcagatccctttcgccatgcaaatggcttaccggtttaatggcataggggtgacccagaacgtgctctatgagaatcagaaactgattgcaaaccagttcaactctgccatcggaaagattcaagatagcctatcctcaacagctagcgccctgggcaaactccaggacgtcgttaatcagaacgcacaggcgctgaatactcttgtgaagcaattgagttctaactttggtgccatctccagcgtactgaatgacatattatcgcgactcgataaggtggaagctgaggtccagatcgacagactgattaccgggaggcttcagtcactgcaaacgtacgtgacacagcagttgatccgcgccgcagagattcgggcttctgccaacctcgcagccaccaaaatgagtgaatgcgttctgggacagtccaagagagtggatttctgtggcaaaggttaccacctaatgagctttccccaatctgctccacatggcgtcgtgttcctgcacgttacttatgtgccggcgcaggagaagaattttaccacagcccctgcaatctgccacgacgggaaagctcatttccccagggaaggagtctttgtaagcaacggcactcactggttcgtgacccagcgcaatttttacgagccacagataattacaacggataacaccttcgtttccgggaattgtgacgtggtcatcggaatcgtgaacaatactgtatatgatcccctccaacctgagctggactcattcaaggaagaacttgataaatactttaagaaccatacaagtccagacgtggatttgggcgacattagcggtatcaatgcctctgtcgttaacattcagaaggaaatagatcgactgaatgaggtggccaaaaacttaaacgaatccctcatcgacctgcaggagcttgggaagtatgagcagtacattaaatggccctggtatatctggctgggattcattgctggcctaatcgcaatagtgatggtcaccatcatgctctgctgtatgacttcatgctgtagttgcctgaagggttgttgcagctgtggctcctgctgcaaatttgacgaagatgactctgagcctgtgttgaagggggttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12504 - RNA, 4094 nt, synthetic construct
  misc_feature 1..4094: note = SARS-CoV-2/France/GE1977/2020__EPI_ISL_414632 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctatttagcacagcctccgcactgggcaaactccaggacgtcgttaatcagaacgcgcaggccctgaatactcttgtgaagcaattgtcaagcaacttcggtgctatcagttctgtactgaatgacatattatcccgactcgataaggtggaagccgaggtccagatcgacagactgattaccgggaggcttcagagcctgcaaacgtacgtgacacagcagttgatccgcgcagctgagattcgggcctcggcaaacctcgccgctaccaaaatgtcagaatgcgttctgggacagtctaagagagtggatttttgtggcaaaggttaccacctaatgagtttcccccaatccgcgccacatggcgtcgtgtttctgcacgttacttatgtgccggcccaggagaagaatttcaccacagctcctgcaatctgccacgacgggaaagcccattttcccagggaaggagtcttcgtaagcaacggcactcactggtttgtgacccagcgcaatttctacgagccacagataattacaacggataacaccttcgtttctgggaattgtgacgtggtcatcggaatcgtgaacaatactgtatatgatcccctccaacctgagctggacagctttaaggaagaacttgataaatacttcaagaaccatacatccccagacgtggatttgggcgacatttcaggtatcaatgccagtgtcgttaacattcagaaggaaatagatcgactgaatgaggtggctaaaaacttaaacgaaagcctcatcgacctgcaggagcttgggaagtatgagcagtacattaaatggccctggtatatctggctgggatttattgcaggcctaatcgccatagtgatggtcaccatcatgctctgctgtatgacttcttgctgttcctgcctgaagggttgttgctcatgtggcagttgctgcaaattcgacgaagatgacagcgagcctgtgttgaagggggttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12505 - RNA, 4094 nt, synthetic construct
  misc_feature 1..4094: note = SARS-CoV-2/Finland/FIN-313/2020__EPI_ISL_414641 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttcaaaactctactcgccctgcatcgctcttatcttaccccgggcgactcctcaagcgggtggacagcaggagccgctgcatactatgtaggttacctgcagcccagaacctttttgctcaagtataatgaaaacggcacgattactgatgccgtggactgcgctctggatcctttaagtgagacaaagtgtaccctgaaatctttcactgtcgaaaaggggatctaccaaacatccaattttagggtgcagccaaccgagagcatagttcggttccccaacattacgaatctctgcccttttggagaggtgttcaacgccacccgcttcgcgtcggtctatgcatggaatcgaaaaagaatctctaactgtgtggccgactactccgtactttacaattcagctagttttagcacattcaagtgctatggcgtttccccaactaaactgaacgacttgtgttttaccaatgtgtacgccgattctttcgtcattaggggtgacgaagtgcggcagatcgcacccgggcagacaggaaagatcgctgattataactacaaactaccggacgattttactggctgcgtcattgcctggaatagcaacaacctggactcaaaggtgggcgggaattataactacctctatcgtctgttccgcaagagtaatcttaaaccttttgagagagatatatccaccgaaatctaccaagcgggaagcacaccctgtaacggtgttgagggcttcaattgctactttccactgcagtcttatgggttccagcctaccaacggagtgggctaccaaccctatagggtagtcgtgttgtcatttgaactcctgcacgccccagcaactgtttgcggtcccaagaaaagtacgaatttagtgaagaacaaatgtgtcaatttcaactttaatgggctgacaggcaccggagtgctaactgagagcaacaagaagttcctccctttccagcagtttggccgggacattgctgataccacagacgccgtacgagatccacagaccctggagatccttgacataactccgtgctccttcgggggagtgtctgttattacacccggtacgaatacctcgaaccaagtcgctgtgttgtaccagggcgtgaattgtactgaagtccctgttgccatccacgcagaccagctgacaccaacctggcgcgtgtatagcacagggtccaacgtgtttcagactagagccggatgcctcatcggcgctgagcatgtaaacaattcatacgaatgtgatattcccatcggtgcggggatttgcgcaagttatcaaacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaaaacctccgtcgactgtacgatgtatatatgcggagattcaacagagtgtagtaatctgttgctccagtacggcagcttttgcacccaactgaacagagccttaactgggatcgcagtggagcaggacaagaatacacaggaagttttcgcacaggtgaaacaaatttataagaccccgcctatcaaagattttggaggtttcaacttttcgcagattctgccagacccctccaagccttctaagaggagcttcatcgaggatctactctttaataaagtaactctggctgacgccggcttcataaagcagtacggggattgtcttggagacatcgcagcccgtgatttgatttgcgctcaaaaattcaacggcctgaccgtcctgcccccactcttaacagacgaaatgatcgcccagtatacgtcagcactgcttgctggtaccattacgagtgggtggacatttggcgccggagcggccttgcagatccctttcgctatgcagatggcataccggtttaatggcataggggtgacccaaaacgtgctctatgagaatcagaagctgattgccaaccagttcaactccgctatcggaaaaattcaggattctctaagctccacagcctcagcactgggcaagctccaagacgtcgttaatcagaacgcgcaggccctgaatactcttgtgaagcagttgagcagtaactttggtgctatctcttccgtactgaatgacatattaagccgactcgataaagtggaagccgaggtccaaatcgacagactgattaccgggaggcttcagtcgctgcagacgtacgtgacacaacagttgatccgcgcagctgagattcgggcctcagcaaacctcgccgctaccaagatgtctgaatgcgttctgggacagagtaaaagagtggatttctgtggcaagggttaccacctaatgtcctttccccagagcgcgccacatggcgtcgtgttcctgcacgttacttatgtgccggcccaagagaaaaattttaccacagcgcctgctatctgccacgacgggaaggcccatttccccagggaaggagtctttgtatctaacggcactcactggttcgtgacccagcgcaatttttacgagccacagataattacaacggataacaccttcgttagcgggaattgtgacgtggtcatcggaatcgtgaacaatactgtatatgatcccctccagcctgagctggactccttcaaagaagaacttgataagtactttaagaaccatacatcaccagacgtggatttgggcgacattagtggtatcaatgccagcgtcgttaacattcaaaaagaaatagatcgactgaatgaggtggctaagaacttaaacgaatctctcatcgacctgcaggagcttgggaaatatgagcagtacattaagtggccctggtatatctggctgggattcattgcaggcctaatcgccatagtgatggtcaccatcatgctctgctgtatgacttcctgctgttcatgcctgaaaggttgttgcagttgtggcagctgctgcaagtttgacgaagatgactccgagcctgtgttgaagggggttaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12506 - RNA, 4094 nt, synthetic construct
  misc_feature 1..4094: note SARS-CoV-2/Netherlands/ZuidHolland_2/2020__EPI_ISL_414556 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcactggagcaggacaaaaatacacaggaagtgttcgcgcaagttaagcagatttataaaaccccgcctatcaaggattttggaggtttcaacttttcgcagattctaccagacccctccaaaccttctaagaggagcttcatcgaggatctcctgtttaataaggtgactcttgctgacgccggcttcataaaacaatacggggattgtttgggagacatcgcagcccgtgatctgatttgcgctcagaagttcaacggcctcaccgtactgcccccattactgacagacgaaatgatcgcccagtatacgtcagcacttttggctggtaccattacgagtgggtggacatttggcgccggagcggccctccagatccctttcgctatgcaaatggcataccggtttaatggcataggggtcacccagaacgtgctgtatgagaatcagaaactaattgccaaccagttcaactccgctatcggaaagattcaagattctctgagctccacagcctcagcactcggcaaactgcaggacgtggtcaatcagaacgcgcaggcccttaatactttggttaagcaactgagcagtaactttggtgctatctcttccgtgttaaatgacatactcagccgactggataaggtagaagccgaggtgcagatcgacagacttattaccgggaggctgcagtcgttgcaaacgtacgtcacacagcagctcatccgcgcagctgagattcgggcctcagcaaacctggccgctaccaaaatgtctgaatgcgtgctaggacagagtaagagagttgatttctgtggcaaaggttaccacctgatgtcctttccccaaagcgcgccacatggcgtggtcttcctccacgtgacttatgttccggcccaggagaagaattttaccacagctcctgcaatctgccacgacgggaaagcccatttccccagggaaggagtgtttgtctctaacggcactcactggttcgtaacccagcgcaatttttacgagccacagataattacaacggataacaccttcgtgagcgggaattgtgacgttgtgatcggaatcgtcaacaatactgtgtatgatcccctgcaacctgagcttgactccttcaaggaagagttggataaatactttaagaaccatacatcaccagacgtagatctgggcgacattagtggtatcaatgccagcgtggtcaacattcagaaggaaatagatcgattaaatgaggttgctaaaaacctcaacgaatctctgatcgaccttcaggagctggggaagtatgagcagtacattaaatggccctggtatatctggctaggattcattgcaggcctcatcgccatagtgatggtgaccatcatgctgtgctgtatgacttcctgctgttcatgcttgaagggttgttgcagttgtggcagctgctgcaaatttgacgaagatgactccgagcctgtcctgaagggggtgaagttacactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12507 - RNA, 4094 nt, synthetic construct
  misc_feature 1..4094: note = SARS-CoV-2/USA/WA-UW31/2020__EPI_ISL_414618 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgccgagggcttcaattgctactttccactgcagtcttatgggttccaacctaccaacggagttggctaccagccctatagggtggtagtcttgtcatttgaactcctgcacgcaccagctactgtgtgcggtcccaaaaagagtacgaatttagttaaaaacaagtgtgtgaatttcaactttaatgggctgacaggcaccggagtcctaactgagagcaacaaaaagttcctccctttccagcagtttggccgggacattgccgataccacagacgctgtgcgagatccacaaaccctggagatccttgacataactccgtgctccttcgggggagtatctgtgattacacccggtacgaatacctcgaaccaggttgccgtcttgtaccaggacgtgaattgtactgaagtgcctgtcgcaatccacgccgatcagctgacaccaacctggcgcgtttatagcacaggctccaacgtgtttcaaactagagctgggtgcctcatcggagcggagcatgtgaacaattcatacgaatgtgacattcccatcggcgcaggtatttgcgccagttatcagacccagacgaactctcctaggcgggctcgcagcgtagcctcccagtcaataatcgcatacaccatgagcctgggggccgaaaattctgtcgcttactccaacaatagtattgccatcccaacaaacttcactatcagcgtgaccacagaaattcttcccgtttctatgactaagacctccgtggattgtacgatgtatatatgcggcgactcaacagagtgtagtaatctgttgctccaatacggcagcttttgcacccagctgaacagagcattaactggaatcgcggtcgagcaggataaaaatacacaggaagtgttcgctcaagttaagcagatttataaaaccccgcctatcaaggactttgggggattcaacttttcgcagattctgccagatccctccaaaccttctaagaggagcttcatcgaggacctactctttaataaggtgactctggccgatgcaggtttcataaaacaatacggcgactgtcttggggatatcgccgctcgtgacttgatttgcgcccagaagttcaacggactgaccgtactgcccccactcttaacagatgaaatgatcgcacagtatacgtcagctctgcttgccggcaccattacgagtggttggacatttggggcgggcgccgctttgcagatccctttcgcaatgcaaatggcctaccggtttaatggaataggcgtcacccagaacgtgctctatgagaatcagaaactgattgctaaccagttcaactccgccatcgggaagattcaagactctctaagctccacagcatcagcgctgggaaaactccaggacgtggtcaatcagaacgcccaggctctgaatactcttgttaagcaattgagcagtaactttggcgccatctcttccgtgctgaatgatatattaagccgactcgacaaggtagaagcagaggtgcagatcgatagactgattaccggtaggcttcagtcgctgcaaacgtacgtcacacagcagttgatccgcgctgccgagattcgggcatcagccaacctcgctgcgaccaaaatgtctgaatgcgtgctggggcagagtaagagagttgacttctgtggaaaaggctaccacctaatgtcctttccccaaagcgccccacatggtgtggtcttcctgcacgtgacttatgttccggcacaggagaagaattttaccacagctcctgccatctgccacgatggcaaagcccatttccccagggaaggggtgtttgtctctaacggaactcactggttcgtaacccagcgcaatttttacgagccacagataattacaacggacaacaccttcgtgagcggcaattgtgatgttgtgatcgggatcgtcaacaatactgtgtatgaccccctccaacctgagctggattccttcaaggaggaacttgacaaatactttaagaaccatacatcaccagatgtagacttgggagatattagtggcatcaatgctagcgtggtcaacattcagaaggaaatagaccgactgaatgaggttgccaaaaacttaaacgaatctctcatcgacctgcaggagcttggtaagtatgagcagtacattaaatggccctggtatatctggctggggttcattgcaggactaatcgcgatagtgatggtgaccatcatgctctgctgtatgacttcctgctgttcatgcctgaagggctgttgcagttgtggtagctgctgcaaatttgatgaagacgattccgagcctgtcttgaagggcgtgaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12508 - RNA, 4094 nt, synthetic construct
  misc_feature 1..4094: note = SARS-CoV-2/South Korea/SNU01/2020__EPI_ISL_411929 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacaccaattctttcacgaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggattttgggctcttgagcctttggtggatctgccaatcggcattaacatcacacggttccagactctactcgccctgcatcgcagctatcttaccccgggcgactcttcctcagggtggacagcaggagccgctgcatactatgtaggttacctgcaacccagaacctttttgctcaaatataatgaaaacggcacgattactgatgccgtggactgcgctctggatcctttaagcgagacaaagtgtaccctgaagagtttcactgtcgaaaaagggatctaccagacatctaattttagggtgcagccaaccgagtccatagttcggttccccaacattacgaatctctgcccttttggagaggtgttcaacgccacccgcttcgcgagcgtctatgcatggaatcgaaagagaatctcgaactgtgtggccgactactctgtactttacaattccgcttcatttagtacattcaaatgctatggcgttagcccaactaagctgaacgacttgtgttttaccaatgtgtacgccgattccttcgtcattaggggtgacgaagtgcggcagatcgcacccgggcaaacaggaaaaatcgctgattataactacaagctaccggacgattttactggctgcgtcattgcctggaactctaataacctggacagcaaagtgggcgggaattataactacctctatcgtctgttccgcaagtcaaatcttaagccttttgagagagatataagtaccgaaatctaccaggcgggatccacaccctgtaacggtgttgagggcttcaattgctactttccactgcagagctatgggttccaacctaccaacggagtgggctaccagccctatagggtagtcgtgttgtcttttgaactcctgcacgccccagcaactgtttgcggtcccaaaaagtcaacgaatttagtgaaaaacaagtgtgtcaatttcaactttaatgggctgacaggcaccggagtgctaactgagagtaacaaaaagttcctccctttccagcagtttggccgggacattgctgataccacagacgccgtacgagatccacaaaccctggagatccttgacataactccgtgcagcttcgggggagtgtccgttattacacccggtacgaatacctctaaccaggtcgctgtgttgtaccaggacgtgaattgtactgaagtccctgttgccatccacgcagatcagctgacaccaacctggcgcgtgtattcgacaggcagcaacgtgtttcaaactagagccgggtgcctcatcggagctgagcatgtaaacaattcctacgaatgtgacattcccatcggcgcgggtatttgcgcatcatatcagacccagacgaacagtcctaggcgggcccgctctgtcgctagccagtccataatcgcctacaccatgtcactgggggcagagaatagcgtggcctactctaacaattccattgctatcccaacaaacttcactatcagtgttaccacagaaattcttcccgtgagcatgactaagacctctgtcgattgtacgatgtatatatgcggcgactccacagagtgttcaaatctgttgctccaatacggaagtttttgcacccagctgaacagagccttaactggcatcgcagtggagcaggataaaaatacacaggaagttttcgcgcaagtgaagcagatttataaaaccccgcctatcaaggactttgggggattcaactttagccagattctgccagatccctcgaaaccttccaagaggtctttcatcgaggacctactctttaataaggtaactctggctgatgccggtttcataaaacaatacggcgactgtcttggggatatcgcagcccgtgacttgatttgcgctcagaagttcaacggactgaccgtcctccctccactgttaacagatgaaatgatcgcccagtatacgagcgcactgcttgctggcaccattacttcaggttggacatttggggccggcgcggccttgcagatccctttcgctatgcaaatggcataccggtttaatggaataggcgtgacccagaacgtgctctatgagaatcagaaactgattgccaaccagttcaacagtgctatcgggaagattcaagactccctatctagcacagcctccgcactgggaaaactccaggacgtcgttaatcagaacgcgcaggccctgaatactcttgtgaagcaattgtcaagcaactttggcgctatcagttctgtactgaatgatatattatcccgactcgacaaggtggaagccgaggtccagatcgatagactgattaccggtaggcttcagagcctgcaaacgtacgtgacacagcagttgatccgcgcagctgagattcgggcctcggcaaacctcgccgctaccaaaatgtcagaatgcgttctggggcagtctaagagagtggacttctgtggaaaaggctaccacctaatgagttttccccaatccgcgccacatggtgtcgtgttcctgcacgttacttatgtgccggcccaggagaagaattttaccacagcacccgctatctgccacgatggcaaagcccatttccccagggaaggggtctttgtaagcaacggaactcactggttcgtgacccagcgcaatttttacgagccacagataattacaacggacaacaccttcgtttctggcaattgtgatgtggtcatcgggatcgtgaacaatactgtatatgaccccctccaacctgagctggatagcttcaaggaagaacttgacaaatactttaagaaccatacatccccagatgtggacttgggagatatttcaggcatcaatgccagtgtcgttaacattcagaaggaaatagaccgactgaatgaggtggctaaaaacttaaacgaaagcctcatcgacctgcaggagcttggtaagtatgagcagtacattaaatggccctggtatatctggctggggttcattgcaggactaatcgccatagtgatggtcaccatcatgctctgctgtatgacttcttgctgttcctgcctgaagggctgttgctcatgtggtagttgctgcaaatttgatgaagacgatagcgagcctgtgttgaagggcgttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12509 - RNA, 4094 nt, synthetic construct
  misc_feature 1..4094: note = SARS-CoV-2/China/WF0004/2020__EPI_ISL_413694 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacacgaatagcttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggactgagtctgagttccgtgtgtacagctccgcgaataactgtacctttgagtatgtgtcacaacctttcctgatggacctggaaggcaagcagggtaattttaaaaacctcagagagttcgtctttaagaacattgatgggtacttcaaaatctacagtaagcacacaccaataaatttagttagggacctgccccagggatttagcgctcttgagcctttggtggatctgccaatcggcattaacatcactcggttccagaccctactcgccctgcatcgctcttatcttacaccgggcgactcctcaagcgggtggaccgcaggagccgctgcatactatgtaggttacctgcaacccagaacgtttttgctcaaatataatgaaaacggcactattacagatgccgtggactgcgctctggatcctttaagtgagaccaagtgtactctgaagtctttcacagtcgaaaaagggatctaccagacctccaattttagggtgcagccaacggagagcatagttcggttccccaacattaccaatctctgcccttttggagaggtgttcaacgccacacgcttcgcgtcggtctatgcatggaatcgaaagagaatctctaactgtgtggccgactactccgtactttacaattcagctagttttagcactttcaaatgctatggcgtttccccaaccaagctgaacgacttgtgttttacaaatgtgtacgccgattctttcgtcattaggggtgacgaagtgcggcagatcgcacccgggcaaactggaaaaatcgctgattataactacaagctaccggacgattttaccggctgcgtcattgcctggaatagcaacaacctggactcaaaagtgggcgggaattataactacctctatcgtctgttccgcaagagtaatcttaagccttttgagagagatatatccacagaaatctaccaggcgggaagcaccccctgtaacggtgttgagggcttcaattgctactttccactgcagtcttatgggttccaacctactaacggagtgggctaccagccctatagggtagtcgtgttgtcatttgaactcctgcacgccccagcaacggtttgcggtcccaaaaagagtacaaatttagtgaaaaacaagtgtgtcaatttcaactttaatgggctgaccggcactggagtgctaaccgagagcaacaaaaagttcctccctttccagcagtttggccgggacattgctgatacaaccgacgccgtacgagatccacaaactctggagatccttgacataacaccgtgctccttcgggggagtgtctgttattacgcccggtaccaatacttcgaaccaggtcgctgtgttgtaccaggacgtgaattgtacagaagtccctgttgccatccacgcagatcagctgaccccaacatggcgcgtgtatagcactggctccaacgtgtttcaaaccagagccgggtgcctcatcggagctgagcatgtaaacaattcatacgaatgtgacattcccatcggcgcgggtatttgcgcaagttatcagacgcagaccaactctcctaggcgggcccgcagcgtcgcttcccagtcaataatcgcctacacaatgagcctgggggcagaaaattctgtggcctactccaacaatagtattgctatcccaactaacttcaccatcagcgttacaactgaaattcttcccgtgtctatgaccaagacgtccgtcgattgtacaatgtatatatgcggcgactcaaccgagtgtagtaatctgttgctccaatacggatctttttgcactcagctgaacagagccttaacaggcatcgcagtggagcaggataaaaatacccaggaagttttcgcgcaagtgaagcagatttataaaactccgcctatcaaggactttgggggattcaacttttcgcagattctgccagatccctccaaaccttctaagaggagcttcatcgaggacctactctttaataaggtaaccctggctgatgccggtttcataaaacaatacggcgactgtcttggggatatcgcagcccgtgacttgatttgcgctcagaagttcaacggactgacagtcctgcccccactcttaacggatgaaatgatcgcccagtatacctcagcactgcttgctggcactattacaagtggttggacctttggggccggcgcggccttgcagatccctttcgctatgcaaatggcataccggtttaatggaataggcgtgacacagaacgtgctctatgagaatcagaaactgattgccaaccagttcaactccgctatcgggaagattcaagactctctaagctccactgcctcagcactgggaaaactccaggacgtcgttaatcagaacgcgcaggccctgaatacccttgtgaagcaattgagcagtaactttggcgctatctcttccgtactgaatgatatattaagccgactcgacaaggtggaagccgaggtccagatcgatagactgattacgggtaggcttcagtcgctgcaaacatacgtgacccagcagttgatccgcgcagctgagattcgggcctcagcaaacctcgccgctactaaaatgtctgaatgcgttctggggcagagtaagagattcgacttttgtggaaaaggctaccacctaatgtccttcccccaaagcgcgccacatggtgtggtctttctgcacgtgacctatgttccggcccaggagaagaatttcacaactgctcctgcaatctgccacgatggcaaagcccattttcccagggaaggggtgttcgtctctaacggaacccactggtttgtaacacagcgcaatttctacgagccacagataattacgaccgacaacactttcgtgagcggcaattgtgatgttgtgatcgggatcgtcaacaatacagtgtatgaccccctccaacctgagctggattcctttaaggaagaacttgacaaatacttcaagaaccatacctcaccagatgtagacttgggagatattagtggcatcaatgccagcgtggtcaacattcagaaggaaatagaccgactgaatgaggttgctaaaaacttaaacgaatctctcatcgacctgcaggagcttggtaagtatgagcagtacattaaatggccctggtatatctggctggggtttattgcaggactaatcgccatagtgatggtgactatcatgctctgctgtatgacatcctgctgttcatgcctgaagggctgttgcagttgtggtagctgctgcaaattcgatgaagacgattccgagcctgtcttgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12510 - RNA, 4094 nt, synthetic construct
  misc_feature 1..4094: note = SARS-CoV-2/China/WF0028/2020__EPI_ISL_413791 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcgttagcggcaattgtgatgtggtcatcgggatcgtgaacaatactgtatatgaccccctccaacctgagctggaatccttcaaggaggaacttgataaatactttaagaaccatacatcaccagacgtggatttgggagacattagtggcatcaatgccagcgtcgttaacattcagaaggagatagatcgactgaatgaagtggctaaaaacttaaacgagtctctcatcgacctgcaggagcttggtaagtatgaacagtacattaaatggccctggtatatctggctggggttcattgcaggactaatcgccatagtgatggtcaccatcatgctctgctgtatgacttcctgctgttcatgcctgaagggctgttgcagttgtggtagctgctgcaaatttgacgaggatgactccgaacctgtgttgaagggcgttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12511 - RNA, 4094 nt, synthetic construct
  misc_feature 1..4094: note = SARS-CoV-2/2019-nCoV/USA-CruiseA-18/2020__MT159716.1 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgaactgcgtgtgtacagctccgcgaataactgtactttcgagtatgtgtcacaaccttttctgatggacctcgaaggcaagcagggtaatttcaaaaacttaagagagtttgtcttcaagaacattgatgggtactttaaaatctacagtaagcacaccccaataaatctggttagggaccttccccagggattcagcgctttggagcctctggtggatctaccaatcggcattaacatcacacggtttcagactctcctggcccttcatcgctcttatctgaccccgggcgactcctcaagcgggtggacagcaggagccgctgcatactatgtaggttacttgcaacccagaaccttcctcctgaaatataatgaaaacggcacgattactgatgccgtggactgcgctttagatcctctgagtgagacaaagtgtaccctcaagtcttttactgtcgaaaaagggatctaccagacatccaatttcagggtgcagccaaccgagagcatagttcggtttcccaacattacgaatctttgccctttcggagaggtgtttaacgccacccgcttcgcgtcggtctatgcatggaatcgaaagagaatctctaactgtgtggccgactactccgtactgtacaattcagctagtttcagcacatttaaatgctatggcgtttccccaactaagttgaacgacctatgtttcaccaatgtgtacgccgattcttttgtcattaggggtgacgaagtgcggcagatcgcacccgggcaaacaggaaaaatcgctgattataactacaagctgccggacgatttcactggctgcgtcattgcctggaatagcaacaacctcgactcaaaagtgggcgggaattataactacctgtatcgtctttttcgcaagagtaatctgaagcctttcgagagagatatatccaccgaaatctaccaggcgggaagcacaccctgtaacggtgttgagggctttaattgctacttcccattgcagtcttatgggtttcaacctaccaacggagtgggctaccagccctatagggtagtcgtgctctcattcgaactgttacacgccccagcaactgtttgcggtcccaaaaagagtacgaatctggtgaaaaacaagtgtgtcaattttaacttcaatgggctaacaggcaccggagtgctcactgagagcaacaaaaagtttctgcctttccagcagttcggccgggacattgctgataccacagacgccgtacgagatccacaaacccttgagatcttggacataactccgtgctcctttgggggagtgtctgttattacacccggtacgaatacctcgaaccaggtcgctgtgctgtaccaggacgtgaattgtactgaagtccctgttgccatccacgcagatcagctcacaccaacctggcgcgtgtatagcacaggctccaacgtgttccaaactagagccgggtgcctgatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagccttggggcagaaaattctgtggcctactccaacaatagtattgctatcccaacaaactttactatcagcgttaccacagaaattctgcccgtgtctatgactaagacctccgtcgattgtacgatgtatatatgcggcgactcaacagagtgtagtaatttgctcctgcaatacggcagcttctgcacccagttaaacagagccctgactggaatcgcagtggagcaggataaaaatacacaggaagtttttgcgcaagtgaagcagatttataaaaccccgcctatcaaggacttcgggggatttaacttctcgcagattctaccagatccctccaaaccttctaagaggagctttatcgaggacctcctgttcaataaggtaactcttgctgatgccggttttataaaacaatacggcgactgtttgggggatatcgcagcccgtgacctgatttgcgctcagaagttcaacggactcaccgtcctgcccccattactgacagatgaaatgatcgcccagtatacgtcagcacttttggctggcaccattacgagtggttggacattcggggccggcgcggccctccagatcccttttgctatgcaaatggcataccggttcaatggaataggcgtgacccagaacgtgctgtatgagaatcagaaactaattgccaaccagtttaactccgctatcgggaagattcaagactctctgagctccacagcctcagcactcggaaaactgcaggacgtcgttaatcagaacgcgcaggcccttaatactttggtgaagcaactgagcagtaacttcggcgctatctcttccgtattaaatgatatactcagccgactggacaaggtggaagccgaggtccagatcgatagacttattaccggtaggctgcagtcgttgcaaacgtacgtgacacagcagctcatccgcgcagctgagattcgggcctcagcaaacctggccgctaccaaaatgtctgaatgcgttctagggcagagtaagagagtggacttttgtggaaaaggctaccacctgatgtccttcccccaaagcgcgccacatggtgtcgtgtttctccacgttacttatgtgccggcccaggagaagaatttcaccacagctcctgcaatctgccacgatggcaaagcccattttcccagggaaggggtcttcgtatctaacggaactcactggtttgtgacccagcgcaatttctacgagccacagataattacaacggacaacacctttgttagcggcaattgtgatgtggtcatcgggatcgtgaacaatactgtatatgaccccctgcaacctgagcttgattccttcaaggaagagttggacaaatacttcaagaaccatacatcaccagatgtggacctgggagatattagtggcatcaatgccagcgtcgttaacattcagaaggaaatagaccgattaaatgaggtggctaaaaacctcaacgaatctctgatcgaccttcaggagctgggtaagtatgagcagtacattaaatggccctggtatatctggctagggtttattgcaggactcatcgccatagtgatggtcaccatcatgctgtgctgtatgacttcctgctgttcatgcttgaagggctgttgcagttgtggtagctgctgcaaattcgatgaagacgattccgagcctgtgctgaagggcgttaagttacactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12512 - RNA, 4094 nt, synthetic construct
  misc_feature 1..4094: note SARS-CoV-2/SARS-CoV-2/Yunnan-01/human/2020/CHN__MT049951.1 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagccaatacgaactctttcaccaggggcgtatactatccggacaaggtgtttcggtcaagtgtcctgcacagcacacaggatctattcctcccctttttctccaatgtgacttggtttcatgctatccacgtttctgggaccaacggaacaaaacgcttcgacaatcctgtgctgccatttaacgatggtgtctacttcgcatcgaccgagaagtcaaatattatacgaggctggatctttgggactacacttgacagcaaaacccagagtctgttgattgtgaacaatgccacgaacgtagttatcaaggtgtgtgagttccagttttgcaatgatcccttcctcggagtctattaccataaaaacaataagtcctggatggagtctgagttccgtgtgtatagctccgcgaacaattgtacttttgaatacgtgtcacaacctttcctgatggacctggaaggcaagcagggtaactttaaaaacctcagagagttcgtctttaagaatattgatgggtatttcaaaatctacagtaagcacaccccaataaacttagttagggacctgccccagggatttagcgctcttgagcctttggtggatctgccaatcggcattaatatcacacggttccagactctactcgccctgcatcgctcttaccttaccccgggcgactcctcaagcgggtggacagcaggagccgctgcatattacgtaggttatctgcaacccagaacctttttgctcaaatacaacgaaaatggcacgattactgatgccgtggactgcgctctggatcctttaagtgagacaaagtgtaccctgaagtctttcactgtcgaaaaagggatctatcagacatccaactttagggtgcagccaaccgagagcatagttcggttccccaatattacgaacctctgcccttttggagaggtgttcaatgccacccgcttcgcgtcggtctacgcatggaaccgaaagagaatctctaattgtgtggccgactattccgtactttacaactcagctagttttagcacattcaaatgctacggcgtttccccaactaagctgaatgacttgtgttttaccaacgtgtatgccgattctttcgtcattaggggtgacgaagtgcggcagatcgcacccgggcaaacaggaaaaatcgctgattacaattataagctaccggacgattttactggctgcgtcattgcctggaacagcaacaatctggactcaaaagtgggcgggaactacaattatctctaccgtctgttccgcaagagtaaccttaagccttttgagagagatatatccaccgaaatctatcaggcgggaagcacaccctgtaatggtgttgagggcttcaactgctactttccactgcagtcttacgggttccaacctaccaatggagtgggctatcagccctacagggtagtcgtgttgtcatttgaactcctgcacgccccagcaactgtttgcggtcccaaaaagagtacgaacttagtgaaaaataagtgtgtcaacttcaattttaacgggctgacaggcaccggagtgctaactgagagcaataaaaagttcctccctttccagcagtttggccgggacattgctgataccacagacgccgtacgagatccacaaaccctggagatccttgacataactccgtgctccttcgggggagtgtctgttattacacccggtacgaacacctcgaatcaggtcgctgtgttgtatcaggacgtgaactgtactgaagtccctgttgccatccacgcagatcagctgacaccaacctggcgcgtgtacagcacaggctccaacgtgtttcaaactagagccgggtgcctcatcggagctgagcatgtaaataactcatatgaatgtgacattcccatcggcgcgggtatttgcgcaagttaccagacccagactaattctcctaggcgggcccgcagcgtcgcttcccagtcaataatcgcctataccatgagcctgggggcagagaactctgtggcctactccaataacagtattgctatcccaacaaatttcactatcagcgttaccacagaaattcttcccgtgtctatgactaagacctccgtcgattgtacgatgtacatatgcggcgactcaacagagtgtagtaacctgttgctccaatatggcagcttttgcacccagctgaatagagccttaactggaatcgcagtggagcaggataaaaacacacaggaagttttcgcgcaagtgaagcagatttacaaaaccccgcctatcaaggactttgggggattcaatttttcgcagattctgccagatccctccaaaccttctaagaggagcttcatcgaggacctactctttaacaaggtaactctggctgatgccggtttcataaaacaatatggcgactgtcttggggatatcgcagcccgtgacttgatttgcgctcagaagttcaatggactgaccgtcctgcccccactcttaacagatgaaatgatcgcccagtacacgtcagcactgcttgctggcaccattacgagtggttggacatttggggccggcgcggccttgcagatccctttcgctatgcaaatggcatatcggtttaacggaataggcgtgacccagaatgtgctctacgagaaccagaaactgattgccaaccagttcaattccgctatcgggaagattcaagactctctaagctccacagcctcagcactgggaaaactccaggacgtcgttaaccagaatgcgcaggccctgaacactcttgtgaagcaattgagcagtaattttggcgctatctcttccgtactgaacgatatattaagccgactcgacaaggtggaagccgaggtccagatcgatagactgattaccggtaggcttcagtcgctgcaaacgtatgtgacacagcagttgatccgcgcagctgagattcgggcctcagcaaatctcgccgctaccaaaatgtctgaatgcgttctggggcagagtaagagagtggacttctgtggaaaaggctaccacctaatgtcctttccccaaagcgcgccacatggtgtcgtgttcctgcacgttacttacgtgccggcccaggagaagaactttaccacagctcctgcaatctgccacgatggcaaagcccatttccccagggaaggggtctttgtatctaatggaactcactggttcgtgacccagcgcaacttttatgagccacagataattacaacggacaataccttcgttagcggcaactgtgatgtggtcatcgggatcgtgaataacactgtatacgaccccctccaacctgagctggattccttcaaggaagaacttgacaaatattttaagaatcatacatcaccagatgtggacttgggagatattagtggcatcaacgccagcgtcgttaatattcagaaggaaatagaccgactgaacgaggtggctaaaaacttaaatgaatctctcatcgacctgcaggagcttggtaagtacgagcagtatattaaatggccctggtacatctggctggggttcattgcaggactaatcgccatagtgatggtcaccatcatgctctgctgtatgacttcctgctgttcatgcctgaagggctgttgcagttgtggtagctgctgcaaatttgatgaagacgattccgagcctgtgttgaagggcgttaagctgcactatacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12513 - RNA, 4094 nt, synthetic construct
  misc_feature 1..4094: note = SARS-CoV-2/USA/WA-UW292/2020__EPI_ISL_418077 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacaccaattctttcacgaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgagctctacaccctgtaacggagttgagggtttcaattgctactttccactgcagtcatatggcttccaacctaccaacggggtgggataccagccctatagggtagtcgtgttgagttttgaactcctgcacgccccagcaactgtttgcggccccaaaaagagcacgaatttagtgaaaaacaagtgtgtcaatttcaactttaatggtctgacagggaccggcgtgctaactgagtccaacaaaaagttcctccctttccagcagtttggacgggacattgctgataccacagacgccgtacgagatccacaaaccctggagatccttgacataactccgtgctctttcggcggggtgtcggttattacacccggaacgaataccagcaaccaggtcgctgtgttgtaccaggacgtgaattgtactgaagtccctgttgccatccacgcagatcagctgacaccaacctggcgcgtgtattccacaggttcaaacgtgtttcaaactagagccggctgcctcatcggggctgagcatgtaaacaatagttacgaatgtgacattcccatcggagcgggcatttgcgcatcttatcagacccagacgaacagccctaggcgggcccgctccgtcgcttcacagagcataatcgcctacaccatgtctctgggtgcagaaaattccgtggcctacagtaacaatagcattgctatcccaacaaacttcactatctctgttaccacagaaattcttcccgtgtccatgactaagacctcagtcgattgtacgatgtatatatgcggggacagtacagagtgtagcaatctgttgctccaatacggctcgttttgcacccagctgaacagagccttaactggaatcgcagtggagcaggataaaaatacacaggaagttttcgcgcaagtgaagcagatttataaaaccccgcctatcaaggactttggcgggttcaacttttcccagattctgccagatccctctaaacctagcaagaggtcattcatcgaggacctactctttaataaggtaactctggctgatgccggattcataaaacaatacggtgactgtcttggcgatatcgcagcccgtgacttgatttgcgctcagaagttcaacgggctgaccgtcctccctccactgttaacagatgaaatgatcgcccagtatacgagtgcactgcttgctggaaccattacttccggctggacatttggtgccggggcggccttgcagatccctttcgctatgcaaatggcataccggtttaatggcataggagtgacccagaacgtgctctatgagaatcagaaactgattgccaaccagttcaactctgctatcggcaagattcaagacagcctatcctcaacagccagcgcactggggaaactccaggacgtcgttaatcagaacgcgcaggccctgaatactcttgtgaagcaattgagttctaactttggagctatctccagcgtactgaatgatatattatcgcgactcgacaaggtggaagccgaggtccagatcgatagactgattaccggcaggcttcagtcactgcaaacgtacgtgacacagcagttgatccgcgcagctgagattcgggcctctgcaaacctcgccgctaccaaaatgagtgaatgcgttctgggtcagtccaagagagtggacttctgtgggaaaggataccacctaatgagctttccccaatctgcgccacatggcgtcgtgttcctgcacgttacttatgtgccggcccaggagaagaattttaccacagcacccgctatctgccacgatggtaaagcccatttccccagggaaggcgtctttgtaagcaacgggactcactggttcgtgacccagcgcaatttttacgagccacagataattacaacggacaacaccttcgtttccggaaattgtgatgtggtcatcggcatcgtgaacaatactgtatatgaccccctccaacctgagctggattcattcaaggaagaacttgacaaatactttaagaaccatacaagtccagatgtggacttgggggatattagcggaatcaatgcctctgtcgttaacattcagaaggaaatagaccgactgaatgaggtggctaaaaacttaaacgaatccctcatcgacctgcaggagcttggcaagtatgagcagtacattaaatggccctggtatatctggctgggtttcattgcagggctaatcgccatagtgatggtcaccatcatgctctgctgtatgacttcatgctgtagttgcctgaagggatgttgcagctgtggctcctgctgcaaatttgatgaagacgattctgagcctgtgttgaagggtgttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12514 - RNA, 4094 nt, synthetic construct
  misc_feature 1..4094: note = SARS-CoV-2/Iceland/192/2020__EPI_ISL_417819 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttttcgtcctgctcccccttgttagctcccagtgcgtgaacctgaccacaagaactcaattgcctccagcctacactaattcttttaccaggggcgtatattacccggacaaggtgttccggtcaagtgtcttacacagcacacaggatctgtttctacccttcttttccaacgtgacttggttccatgctatccacgtttctgggaccaatggaacaaaacgctttgacaaccctgtgctcccattcaatgatggtgtctattttgcatcgaccgagaagtcaaacattatacgaggctggatcttcgggactacactggacagcaaaacccagagtcttctgattgtgaataacgccacgaatgtagttatcaaggtgtgtgaatttcagttctgcaacgatcccttcttgggagtctactatcataaaaataacaagtcctggatggagtctgaatttcgtgtgtacagctccgcgaataactgtactttcgagtatgtgtcacaaccttttctcatggacctggaaggcaagcagggtaatttcaaaaacctgagagagtttgtcttcaagaacattgatgggtactttaaaatctacagtaagcacaccccaataaatctcgttagggacttaccccagggattcagcgctctggagcctcttgtggatttgccaatcggcattaacatcacacggtttcagactctgctagccctccatcgctcttatctgaccccgggcgactcctcaagcgggtggacagcaggagccgctgcatactatgtaggttaccttcaacccagaaccttcctgttgaaatataatgaaaacggcacgattactgatgccgtggactgcgctctcgatcctctgagtgagacaaagtgtaccttaaagtcttttactgtcgaaaaagggatctaccagacatccaatttcagggtgcagccaaccgagagcatagttcggtttcccaacattacgaatctgtgccctttcggagaggtgttcaacgccacccgctttgcgtcggtctatgcatggaatcgaaagagaatctctaactgtgtggccgactactccgtactctacaattcagctagtttcagcacatttaaatgctatggcgtttccccaactaaacttaacgacctgtgtttcaccaatgtgtacgccgattcttttgtcattaggggtgacgaagtgcggcagatcgcacccgggcaaacaggaaagatcgctgattataactacaagttgccggacgatttcactggctgcgtcattgcctggaatagcaacaacctagactcaaaagtgggcgggaattataactacctgtatcgtctctttcgcaagagtaatctgaagcctttcgagagagatatatccaccgaaatctaccaggcgggaagcacaccctgtaacggtgttgagggctttaattgctacttcccacttcagtcttatgggtttcaacctaccaacggagtgggctaccagccctatagggtagtcgtgctgtcattcgaattgctccacgccccagcaactgtttgcggtcccaaaaagagtacgaatctggtgaaaaacaagtgtgtcaattttaacttcaatgggttaacaggcaccggagtgctgactgagagcaacaaaaagttcctaccttttcagcagttcggccgggacattgctgataccacagacgccgtacgagatccacaaaccctcgagatcctggacataactccgtgctcctttgggggagtgtctgttattacacccggtacgaatacctcgaaccaggtcgctgtgctttaccagggcgtgaattgtactgaagtccctgttgccatccacgcagaccagttgacaccaacctggcgcgtgtatagcacagggtccaacgtgttccaaactagagccggatgcctgatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctcggcgcagaaaattctgtggcctactccaacaatagtattgctatcccaacaaactttactatcagcgttaccacagaaattctgcccgtgtctatgactaagacctccgtcgactgtacgatgtatatatgcggagattcaacagagtgtagtaatcttctgttgcaatacggcagcttctgcacccagctcaacagagccctgactgggatcgcagtggagcaggacaaaaatacacaggaagtttttgcgcaagtgaagcagatttataaaaccccgcctatcaaggatttcggaggttttaacttctcgcagattttaccagacccctccaaaccttctaagaggagctttatcgaggatctgctattcaataaggtaactctcgctgacgccggcttcataaaacaatacggggattgtctgggagacatcgcagcccgtgatcttatttgcgctcagaagtttaacggcttgaccgtcctgcccccactcctgacagacgaaatgatcgcccagtatacgtcagcattactggctggtaccattacgagtgggtggacattcggcgccggagcggcccttcagatcccttttgctatgcaaatggcataccggttcaatggcataggggtgacccagaacgtgttgtatgagaatcagaaactcattgccaaccagtttaactccgctatcggaaagattcaagattctctgagctccacagcctcagcactaggcaaactgcaggacgtcgttaatcagaacgcgcaggccctcaatactctggtgaagcaacttagcagtaacttcggtgctatctcttccgtattgaatgacatactgagccgattagataaggtggaagccgaggtccagatcgacagactcattaccgggaggctgcagtcgcttcaaacgtacgtgacacagcagctgatccgcgcagctgagattcgggcctcagcaaacttggccgctaccaaaatgtctgaatgcgttctcggacagagtaagagagtggatttttgtggcaaaggttaccacctgatgtccttcccccaaagcgcgccacatggcgtcgtgtttctacacgttacttatgtgccggcccaggagaagaatttcaccacagctcctgcaatctgccacgacgggaaagcccattttcccagggaaggagtcttcgtatctaacggcactcactggtttgtgacccagcgcaatttctacgagccacagataattacaacggataacaccttcgttagcgggaattgtgacgtggtcatcggaatcgtgaacaatactgtatatgatcccctgcaacctgagctcgactcctttaaggaggagctggataaatacttcaagaaccatacatcaccagacgtggatcttggcgacattagtggtatcaatgccagcgtcgttaacattcagaaggaaatagatcgattgaatgaggtggctaaaaacctgaacgaatctttaatcgacctccaggagctggggaagtatgagcagtacattaaatggccctggtatatctggcttggatttattgcaggcctgatcgccatagtgatggtcaccatcatgctatgctgtatgacttcctgctgttcatgcctcaagggttgttgcagttgtggcagctgctgcaaattcgacgaagatgactccgagcctgtgctgaagggggttaagttgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12515 - RNA, 4094 nt, synthetic construct
  misc_feature 1..4094: note = SARS-CoV-2/Belgium/ULG-6939/2020__EPI_ISL_417020 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggtttactccaacaatagtattgccatcccaacaaacttcactatcagcgtgaccacagaaattcttcccgtctctatgactaagacctccgtggactgtacgatgtatatatgcggagattcaacagagtgtagtaatctgttgctccaatacggcagcttttgcacccagctgaacagagctttaactgggatcgccgttgagcaggacaaaaatacacaggaagtgttcgcacaagtaaagcagatttataaaaccccgcctatcaaggattttggaggtttcaacttttcgcagattctgccagacccctccaaaccttctaagaggagcttcatcgaggatctactctttaataaggtcactctggcggacgctggcttcataaaacaatacggggattgtcttggagacatcgccgcacgtgatttgatttgcgcccagaagttcaacggcctgaccgtgctgcccccactcttaacagacgaaatgatcgctcagtatacgtcagccctgcttgcaggtaccattacgagtgggtggacatttggcgctggagccgcgttgcagatccctttcgccatgcaaatggcttaccggtttaatggcataggggtgacccagaacgtcctctatgagaatcagaaactgattgcaaaccagttcaactccgccatcggaaagattcaagattctctaagctccacagcttcagccctgggcaaactccaggacgttgtgaatcagaacgcacaggcgctgaatactcttgtaaagcaattgagcagtaactttggtgccatctcttccgtgctgaatgacatattaagccgactcgataaggtcgaagctgaggtgcagatcgacagactgattaccgggaggcttcagtcgctgcaaacgtacgttacacagcagttgatccgcgccgcagagattcgggcttcagccaacctcgcagccaccaaaatgtctgaatgcgtgctgggacagagtaagagagtcgatttctgtggcaaaggttaccacctaatgtcctttccccaaagcgctccacatggcgtggttttcctgcacgtgacttatgtcccggcgcaggagaagaattttaccacagcccctgcaatctgccacgacgggaaagctcatttccccagggaaggagtatttgtgtctaacggcactcactggttcgttacccagcgcaatttttacgagccacagataattacaacggataacaccttcgtgagcgggaattgtgacgtcgtgatcggaatcgtaaacaatactgtgtatgatcccctccaacctgagctggactccttcaaggaagaacttgataaatactttaagaaccatacatcaccagacgtcgatttgggcgacattagtggtatcaatgccagcgttgtgaacattcagaaggaaatagatcgactgaatgaggtggccaaaaacttaaacgaatctctcatcgacctgcaggagcttgggaagtatgagcagtacattaaatggccctggtatatctggctgggattcattgctggcctaatcgcaatagtcatggtgaccatcatgctctgctgtatgacttcctgctgttcatgcctgaagggttgttgcagttgtggcagctgctgcaaatttgacgaagatgactccgagcctgttttgaagggggtaaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12516 - RNA, 4094 nt, synthetic construct
  misc_feature 1..4094: note = SARS-CoV-2/France/HF2496/2020__EPI_ISL_418231 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgtcgcacgtgatttgatttgcgcccagaagttcaacggcctgaccgtgctgcccccactcttaacagacgaaatgatcgctcagtatacgtcagccctgcttgcaggtaccattacgagtgggtggacatttggcgctggagccgcgttgcagatccctttcgccatgcaaatggcttaccggtttaatggcataggggtgacccagaacgtcctctatgagaatcagaaactgattgcaaaccagttcaactccgccatcggaaagattcaagattctctaagctccacagcttcagccctgggcaaactccaggacgttgtgaatcagaacgcacaggcgctgaatactcttgtaaagcaattgagcagtaactttggtgccatctcttccgtgctgaatgacatattaagccgactcgataaggtcgaagctgaggtgcagatcgacagactgattaccgggaggcttcagtcgctgcaaacgtacgttacacagcagttgatccgcgccgcagagattcgggcttcagccaacctcgcagccaccaaaatgtctgaatgcgtgctgggacagagtaagagagtcgatttctgtggcaaaggttaccacctaatgtcctttccccaaagcgctccacatggcgtggttttcctgcacgtgacttatgtcccggcgcaggagaagaattttaccacagcccctgcaatctgccacgacgggaaagctcatttccccagggaaggagtatttgtgtctaacggcactcactggttcgttacccagcgcaatttttacgagccacagataattacaacggataacaccttcgtgagcgggaattgtgacgtcgtgatcggaatcgtaaacaatactgtgtatgatcccctccaacctgagctggactccttcaaggaagaacttgataaatactttaagaaccatacatcaccagacgtcgatttgggcgacattagtggtatcaatgccagcgttgtgaacattcagaaggaaatagatcgactgaatgaggtggccaaaaacttaaacgaatctctcatcgacctgcaggagcttgggaagtatgagcagtacattaaatggccctggtatatctggctgggattcattgctggcctaatcgcaatagtcatggtgaccatcatgctctgctgtatgacttcctgctgttcatgcctgaagggttgttgcagttgtggcagctgctgcaaatttgacgaagatgactccgagcctgttttgaagggggtaaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12517 - RNA, 4094 nt, synthetic construct
  misc_feature 1..4094: note = SARS-CoV-2/USA/WA-UW291/2020__EPI_ISL_418076 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaatactctctaagctccacagcctcagcactgggcaaactccaggatgtcgttaatcagaacgcgcaggccctgaatactcttgtgaagcaattgagcagtaactttggtgctatctcttccgtactgaatgacatattaagccgactcgacaaggtggaagccgaggtccagatcgatagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggacttctgtggcaaaggttatcacctaatgtcctttccccaaagcgcgccacatggcgtcgtgttcctgcacgttacttacgtgccggcccaggagaagaattttaccacagctcctgcaatctgccacgatgggaaagcccatttccccagggaaggagtctttgtatctaacggcactcactggttcgtgacccagcgcaatttttatgagccacagataattacaacggacaacaccttcgttagcgggaattgtgatgtggtcatcggaatcgtgaacaatactgtatacgaccccctccaacctgagctggattccttcaaggaagaacttgacaaatattttaagaaccatacatcaccagatgtggacttgggcgatattagtggtatcaatgccagcgtcgttaacattcagaaggaaatagaccgactgaatgaggtggctaaaaacttaaacgaatctctcatcgatctgcaggagcttgggaagtacgagcagtatattaaatggccctggtacatctggctgggattcattgcaggcctaatcgccatagtgatggtcaccatcatgctctgctgtatgacttcctgctgttcatgcctgaagggttgttgcagttgtggcagctgctgcaaatttgacgaagacgattccgagcctgtgttgaagggggttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12518 - RNA, 4094 nt, synthetic construct
  misc_feature 1..4094: note = SARS-CoV-2/Portugal/PT0034/2020__EPI_ISL_418019 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctaagctccacagcctcagcactgggcaaactccaggacgtcgttaatcagaacgcgcaggccctgaatactcttgtgaagcaattgagcagtaactttggtgctatctcttccgtactgaatgacatattaagccgactcgataaggtggaagccgaggtccagatcgacagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggatttctgtggcaaaggttaccacctaatgtcctttccccaaagcgcgccacatggcgtcgtgttcctgcacgttacttatgtgccggcccaggagaagaattttaccacagctcctgcaatctgccacgacgggaaagcccatttccccagggaaggagtctttgtatctaacggcactcactggttcgtgacccagcgcaatttttacgagccacagataattacaacggataacaccttcgttagcgggaattgtgacgtggtcatcggaatcgtgaacaatactgtatatgatcccctccaacctgagctggactccttcaaggaagaacttgataaatactttaagaaccatacatcaccagacgtggatttgggcgacattagtggtatcaatgccagcgtcgttaacattcagaaggaaatagatcgactgaatgaggtggctaaaaacttaaacgaatctctcatcgacctgcaggagcttgggaagtatgagcagtacattaaatggccctggtatatctggctgggattcattgcaggcctaatcgccatagtgatggtcaccatcatgctctgctgtattacttcctgctgttcatgcctgaagggttgttgcagttgtggcagctgctgcaaatttgacgaagatgactccgagcctgtgttgaagggggttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12519 - RNA, 4094 nt, synthetic construct
  misc_feature 1..4094: note = SARS-CoV-2/Iceland/202/2020__EPI_ISL_417750 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcgttagcggcaattgtgatgtggtcatcgggatcgtgaacaatactgtatatgaccccctccaacctgagctggattccttcaaggaggaacttgacaaatactttaagaaccatacatcaccagatgtggacttgggagatattcccggcatcaatgccagtgtcgttaacattcagaaggaaatagaccgactgaatgaggtggctaaaaacttaaacgaaagcctcatcgacctgcaggagcttggtaagtatgagcagtacattaaatggccttggtatatctggctggggttcattgcaggactaatcgccatagtgatggtcaccatcatgctctgctgtatgacttcttgctgttcctgcctgaagggctgttgctcatgtggtagttgctgcaaatttgatgaagacgatagcgagccggtgttgaagggcgttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12520 - RNA, 4094 nt, synthetic construct
  misc_feature 1..4094: note = SARS-CoV-2/USA/WA-UW261/2020__EPI_ISL_418046 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacacgaatagcttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcacatcggtctatgcgtggaatcgaaagagaatctctaactgtgtggcagactactccgtactttacaattcagccagttttagcactttcaaatgctatggcgtttccccaaccaagctgaacgacttgtgttttacaaatgtgtacgctgattctttcgtcattaggggtgacgaagtgcggcagatcgcccccgggcaaactggaaaaatcgcagattataactacaagctaccggacgattttaccggctgcgtcattgcttggaatagcaacaacctggactcaaaagtgggcgggaattataactacctctatcgtctgttccgcaagagtaatcttaagccttttgagagagatatatccacagaaatctaccaggccggaagcaccccctgtaacggtgttgagggcttcaattgctactttccactgcagtcttatgggttccaacctactaacggagtgggctaccagccctatagggtagtcgtgttgtcatttgaactcctgcacgcgccagccacggtttgcggtcccaaaaagagtacaaatttagtgaaaaacaagtgtgtcaatttcaactttaatgggctgaccggcactggagtgctaaccgagagcaacaaaaagttcctccctttccagcagtttggccgggacattgcagatacaaccgacgctgtacgagatccacaaactctggagatccttgacataacaccgtgctccttcgggggagtgtctgttattacgcccggtaccaatacttcgaaccaggtcgccgtgttgtaccaggacgtgaattgtacagaagtccctgttgctatccacgccgatcagctgaccccaacatggcgcgtgtatagcactggctccaacgtgtttcaaaccagagcagggtgcctcatcggagccgagcatgtaaacaattcatacgaatgtgacattcccatcggcgctggtatttgcgcgagttatcagacgcagaccaactctcctaggcgggcacgcagcgtcgcctcccagtcaataatcgcttacacaatgagcctgggggccgaaaattctgtggcatactccaacaatagtattgccatcccaactaacttcaccatcagcgttacaactgaaattcttcccgtgtctatgaccaagacgtccgtcgattgtacaatgtatatatgcggcgactcaaccgagtgtagtaatctgttgctccaatacggatctttttgcactcagctgaacagagctttaacaggcatcgccgtggagcaggataaaaatacccaggaagttttcgcacaagtgaagcagatttataaaactccgcctatcaaggactttgggggattcaacttttcgcagattctgccagatccctccaaaccttctaagaggagcttcatcgaggacctactctttaataaggtaaccctggcggatgctggtttcataaaacaatacggcgactgtcttggggatatcgccgcacgtgacttgatttgcgcccagaagttcaacggactgacagtcctgcccccactcttaacggatgaaatgatcgctcagtatacctcagccctgcttgcaggcactattacaagtggttggacctttggggctggcgccgcgttgcagatccctttcgccatgcaaatggcttaccggtttaatggaataggcgtgacacagaacgtgctctatgagaatcagaaactgattgcaaaccagttcaactccgccatcgggaagattcaagactctctaagctccactgcttcagccctgggaaaactccaggacgtcgttaatcagaacgcacaggcgctgaatacccttgtgaagcaattgagcagtaactttggcgccatctcttccgtactgaatgatatattaagccgactcgacaaggtggaagctgaggtccagatcgatagactgattacgggtaggcttcagtcgctgcaaacatacgtgacccagcagttgatccgcgccgcagagattcgggcttcagccaacctcgcagccactaaaatgtctgaatgcgttctggggcagagtaagagagtggacttctgtggaaaaggctaccacctaatgtcctttccccaaagcgctccacatggtgtcgtgttcctgcacgttacctatgtgccggcgcaggagaagaattttacaactgcccctgcaatctgccacgatggcaaagctcatttccccagggaaggggtctttgtatctaacggaacccactggttcgtgacacagcgcaatttttacgagccacagataattacgaccgacaacactttcgttagcggcaattgtgatgtggtcatcgggatcgtgaacaatacagtatatgaccccctccaacctgagctggattccttcaaggaagaacttgacaaatactttaagaaccatacctcaccagatgtggacttgggagatattagtggcatcaatgccagcgtcgttaacattcagaaggaaatagaccgactgaatgaggtggccaaaaacttaaacgaatctctcatcgacctgcaggagcttggtaagtatgagcagtacattaaatggccctggtatatctggctggggttcattgctggactaatcgcaatagtgatggtcactatcatgctctgctgtatgacatcctgctgttcatgcctgaagggctgttgcagttgtggtagctgctgcaaatttgatgaagacgattccgagcctgtgttgaagggcgttaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12521 - RNA, 4094 nt, synthetic construct
  misc_feature 1..4094: note = SARS-CoV-2/Portugal/PT0035/2020__EPI_ISL_418020 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacacgaatagcttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggatctttttgcacccagctgaacagagccttaactggcatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatctcagcacgtgacttgatttgcgcccagaagttcaacggactgaccgtcctgcccccactcttaacagatgaaatgatcgctcagtatacgagtgccctgcttgcaggcaccattacttccggttggacatttggggctggcgccgcgttgcagatccctttcgccatgcaaatggcttaccggtttaatggaataggcgtgacccagaacgtgctctatgagaatcagaaactgattgcaaaccagttcaactctgccatcgggaagattcaagacagcctatcctcaacagctagcgccctgggaaaactccaggacgtcgttaatcagaacgcacaggcgctgaatactcttgtgaagcaattgagttctaactttggcgccatctccagcgtactgaatgatatattatcgcgactcgacaaggtggaagctgaggtccagatcgatagactgattaccggtaggcttcagtcactgcaaacgtacgtgacacagcagttgatccgcgccgcagagattcgggcttctgccaacctcgcagccaccaaaatgagtgaatgcgttctggggcagtccaagagagtggacttctgtggaaaaggctaccacctaatgagctttccccaatctgctccacatggtgtcgtgttcctgcacgttacttatgtgccggcgcaggagaagaattttaccacagcccctgcaatctgccacgatggcaaagctcatttccccagggaaggggtctttgtaagcaacggaactcactggttcgtgacccagcgcaatttttacgagccacagataattacaacggacaacaccttcgtttccggcaattgtgatgtggtcatcgggatcgtgaacaatactgtatatgaccccctccaacctgagctggattcattcaaggaagaacttgacaaatactttaagaaccatacaagtccagatgtggacttgggagatattagcggcatcaatgcctctgtcgttaacattcagaaggaaatagaccgactgaatgaggtggccaaaaacttaaacgaatccctcatcgacctgcaggagcttggtaagtatgagcagtacattaaatggccctggtatatctggctggggttcattgctggactaatcgcaatagtgatggtcaccatcatgctctgctgtatgacttcatgctgtagttgcctgaagggctgttgcagctgtggttcctgctgcaaatttgatgaagacgattctgagcctgtgttgaagggcgttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12522 - RNA, 4094 nt, synthetic construct
  misc_feature 1..4094: note = SARS-CoV-2/USA/NY-NYUMC7/2020__EPI_ISL_418192 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctaccatcacaaaaataacaagtcctggatggagtctgagttccgtgtgtatagctccgcgaataactgtacttttgagtacgtgtcacaacctttcctgatggacctggaaggcaagcagggtaattttaaaaacctcagagagttcgtctttaagaacattgatgggtatttcaaaatctacagtaagcataccccaataaatttagttagggacctgccccagggatttagcgctcttgagcctttggtggatctgccaatcggcattaacatcacacggttccagactctactcgccctgcaccgctcttaccttaccccgggcgactcctcaagcgggtggacagcaggagccgctgcatattacgtaggttatctgcaacccagaacctttttgctcaaatacaatgaaaacggcacgattactgatgccgtggactgcgctctggatcctttaagtgagacaaagtgtaccctgaagtctttcactgtcgaaaaagggatctatcagacatccaattttagggtgcagccaaccgagagcatagttcggttccccaacattacgaatctctgcccttttggagaggtgttcaacgccacccgcttcgcgtcggtctacgcatggaatcgaaagagaatctctaactgtgtggccgactattccgtactttacaattcagctagttttagcacattcaaatgctacggcgtttccccaactaagctgaacgacttgtgttttaccaatgtgtatgccgattctttcgtcattaggggtgacgaagtgcggcagatcgcacccgggcaaacaggaaaaatcgctgattacaactataagctaccggacgattttactggctgcgtcattgcctggaatagcaacaacctggactcaaaagtgggcgggaattacaactatctctaccgtctgttccgcaagagtaatcttaagccttttgagagagatatatccaccgaaatctatcaggcgggaagcacaccctgtaacggtgttgagggcttcaattgctactttccactgcagtcttacgggttccaacctaccaacggagtgggctatcagccctacagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtatcagggcgtgaattgtactgaagtccctgttgccatccatgcagaccagctgacaccaacctggcgcgtgtacagcacagggtccaacgtgtttcaaactagagccggatgcctcatcggcgctgagcacgtaaacaattcatatgaatgtgatattcccatcggtgcggggatttgcgcaagttaccagacccagacgaactctcctaggcgggcccgcagcgtcgcttcccagtcaataatcgcctataccatgagcctgggcgcagaaaattctgtggcctactccaacaatagtattgctatcccaacaaacttcactatcagcgttaccacagaaattcttcccgtgtctatgactaagacctccgtcgactgtacgatgtacatatgcggagattcaacagagtgtagtaatctgttgctccaatatggcagcttttgcacccagctgaacagagccttaactgggatcgcagtggagcaggacaaaaatacacaggaagttttcgcgcaagtgaagcagatttacaaaaccccgcctatcaaggattttggaggtttcaacttttcgcagattctgccagacccctccaaaccttctaagaggagcttcatcgaggatctactctttaataaggtaactctggctgacgccggcttcataaaacaatatggggattgtcttggagacatcgcagcccgtgatttgatttgcgctcagaagttcaacggcctgaccgtcctgcccccactcttaacagacgaaatgatcgcccagtacacgtcagcactgcttgctggtaccattacgagtgggtggacatttggcgccggagcggccttgcagatccctttcgctatgcaaatggcatatcggtttaatggcataggggtgacccagaacgtgctctacgagaatcagaaactgattgccaaccagttcaactccgctatcggaaagattcaagattctctaagctccacagcctcagcactgggcaaactccaggacgtcgttaatcagaacgcgcaggccctgaatactcttgtgaagcaattgagcagtaactttggtgctatctcttccgtactgaatgacatattaagccgactcgataaggtggaagccgaggtccagatcgacagactgattaccgggaggcttcagtcgctgcaaacgtatgtgacacagcagttgatccgcgcagctgagattcgggcctcagcaaacctcgccgctaccaaaatgtctgaatgcgttctgggacagagtaagagagtggatttctgtggcaaaggttaccatctaatgtcctttccccaaagcgcgccacacggcgtcgtgttcctgcacgttacttacgtgccggcccaggagaagaattttaccacagctcctgcaatctgccatgacgggaaagcccacttccccagggaaggagtctttgtatctaacggcactcattggttcgtgacccagcgcaatttttatgagccacagataattacaacggataacaccttcgttagcgggaattgtgacgtggtcatcggaatcgtgaacaatactgtatacgatcccctccaacctgagctggactccttcaaggaagaacttgataaatattttaagaaccacacatcaccagacgtggatttgggcgacattagtggtatcaatgccagcgtcgttaacattcagaaggaaatagatcgactgaatgaggtggctaaaaacttaaacgaatctctcatcgacctgcaggagcttgggaagtacgagcagtatattaaatggccctggtacatctggctgggattcattgcaggcctaatcgccatagtgatggtcaccatcatgctctgctgtatgacttcctgctgttcatgcctgaagggttgttgcagttgtggcagctgctgcaaatttgacgaagatgactccgagcctgtgttgaagggggttaagctgcattatacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12523 - RNA, 4094 nt, synthetic construct
  misc_feature 1..4094: note = SARS-CoV-2/Iceland/189/2020__EPI_ISL_417709 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacaccaattctttcacgaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcaccaaacaatacggggattgtcttggagacatagcagcccgtgatttgatctgcgctcagaagttcaacggcctgacagtcctccctccactgttaacggacgaaatgattgcccagtatacctcagcactgcttgctggtactatcacaagtgggtggacctttggcgccggagcggccttgcagattcctttcgctatgcaaatggcataccggtttaatggcatcggggtgacacagaacgtgctctatgagaatcagaaactgatagccaaccagttcaactccgctattggaaagatccaagattctctaagctccactgcctcagcactgggcaaactccaggacgtcgttaatcagaacgcgcaggccctgaatacccttgtgaagcaattgagcagtaactttggtgctatttcttccgtactgaatgacatcttaagccgactcgataaggtggaagccgaggtccagatagacagactgatcacggggaggcttcagtcgctgcaaacatacgtgacccagcagttgattcgcgcagctgagatccgggcctcagcaaacctcgccgctactaaaatgtctgaatgcgttctgggacagagtaagagagtggatttctgtggcaaaggttaccacctaatgtcctttccccaaagcgcgccacatggcgtcgtgttcctgcacgttacctatgtgccggcccaggagaagaattttacaactgcacccgctatttgccacgacgggaaagcccatttccccagggaaggagtctttgtatctaacggcacccactggttcgtgacacagcgcaatttttacgagccacagatcataacgaccgataacactttcgttagcgggaattgtgacgtggtcattggaatcgtgaacaatacagtatatgatcccctccaacctgagctggactccttcaaggaagaacttgataaatactttaagaaccatacctcaccagacgtggatttgggcgacatcagtggtattaatgccagcgtcgttaacatccagaaggaaattgatcgactgaatgaggtggctaaaaacttaaacgaatctctcatagacctgcaggagcttgggaagtatgagcagtacatcaaatggccctggtatatttggctgggattcatcgcaggcctaattgccatcgtgatggtcactataatgctctgctgtatgacatcctgctgttcatgcctgaagggttgttgcagttgtggcagctgctgcaaatttgacgaagatgactccgagcctgtgttgaagggggttaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12524 - RNA, 4094 nt, synthetic construct
  misc_feature 1..4094: note = SARS-CoV-2/Australia/NSW56/2020__EPI_ISL_417408 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacacgaatagcttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggatctttttgcacccagctgaacagagccttaactggcatcgcagtggagcaggataaaaatacacaggaagttttcgcgcaagtgaagcagatttataaaaccccgcctatcaaggactttgggggattcaacttttcgcagattctgccagattcctctaaacccagcaagaggtcattcatcgaggacctactctttaataaggtaactctggctgatgccggtttcataaaacaatacggcgactgtcttggggatatcgcagcccgtgacttgatttgcgctcagaagttcaacggactgaccgtcctccctcccctgttaacagatgaaatgatcgcccagtatacgagtgcactgcttgctggcaccattacttccggttggacatttggggccggcgcggccttgcagatcccattcgctatgcaaatggcataccggtttaatggaataggcgtgacccagaacgtgctctatgagaatcagaaactgattgccaaccagttcaactctgctatcgggaagattcaagacagcctatcctcaacagccagcgcactgggaaaactccaggacgtcgttaatcagaacgcgcaggccctgaatactcttgtgaagcaattgagttctaactttggcgctatctccagcgtactgaatgatatattatcgcgactcgacaaggtggaagccgaggtccagatcgatagactgattaccggtaggcttcagtcactgcaaacgtacgtgacacagcagttgatccgcgcagctgagattcgggcctctgcaaacctcgccgctaccaaaatgagtgaatgcgttctggggcagtccaagagagtggacttctgtggaaaaggctaccacctaatgagctttcctcaatctgcgccccatggtgtcgtgttcctgcacgttacttatgtgccagcccaggagaagaattttaccacagcaccggctatctgccacgatggcaaagcccatttccctagggaaggggtctttgtaagcaacggaactcactggttcgtgacccagcgcaatttttacgagccccagataattacaacggacaacaccttcgtttccggcaattgtgatgtggtcatcgggatcgtgaacaatactgtatatgacccactccaacccgagctggattcattcaaggaagaacttgacaaatactttaagaaccatacaagtcctgatgtggacttgggagatattagcggcatcaatgcctctgtcgttaacattcagaaggaaatagaccgactgaatgaggtggctaaaaacttaaacgaatccctcatcgacctgcaggagcttggtaagtatgagcagtacattaaatggccatggtatatctggctggggttcattgcaggactaatcgccatagtgatggtcaccatcatgctctgctgtatgacttcatgctgtagttgcctgaagggctgttgcagctgtggttcctgctgcaaatttgatgaagacgattctgagcccgtgttgaagggcgttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12525 - RNA, 4094 nt, synthetic construct
  misc_feature 1..4094: note = SARS-CoV-2/Iceland/280/2020__EPI_ISL_417608 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcacacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccagtacggcagcttttgcacccaactgaacagagccttaactgggatcgcagtggagcaggacaaaaatacacaggaagttttcgcacaggtgaagcaaatttataaaaccccgcctatcaaggattttggaggtttcaacttttcgcagattctgccagacccctccaaaccttctaagaggagcttcatcgaggatctactctttaataaggtaactctggctgacgccggcttcataaaacagtacggggattgtcttggagacatcgcagcccgtgatttgatttgcgctcaaaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcagatggcataccggtttaatggcataggggtgacccaaaacgtgctctatgagaatcagaaactgattgccaaccagttcaactccgctatcggaaagattcaggattctctaagctccacagcctcagcactgggcaaactccaagacgtcgttaatcagaacgcgcaggccctgaatactcttgtgaagcagttgagcagtaactttggtgctatctcttccgtactgaatgacatattaagccgactcgataaggtggaagccgaggtccaaatcgacagactgattaccgggaggcttcagtcgctgcagacgtacgtgacacaacagttgatccgcgcagctgagattcgggcctcagcaaacctcgccgctaccaaaatgtctgaatgcgttctgggacagagtaagagagtggatttctgtggcaaaggttaccatctaatgtcctttccccagagcgcgccacacggcgtcgtgttcctgcacgttacttatgtgccggcccaagagaagaattttaccacagcgcctgctatctgccatgacgggaaagcccacttccccagggaaggagtctttgtatctaacggcactcattggttcgtgacccagcgcaatttttacgagccacagataattacaacggataacaccttcgttagcgggaattgtgacgtggtcatcggaatcgtgaacaatactgtatatgatcccctccagcctgagctggactccttcaaggaagaacttgataaatactttaagaaccacacatcaccagacgtggatttgggcgacattagtggtatcaatgccagcgtcgttaacattcaaaaggaaatagatcgactgaatgaggtggctaaaaacttaaacgaatctctcatcgacctgcaggagcttgggaagtatgagcagtacattaaatggccctggtatatctggctgggattcattgcaggcctaatcgccatagtgatggtcaccatcatgctctgctgtatgacttcctgctgttcatgcctgaagggttgttgcagttgtggcagctgctgcaaatttgacgaagatgactccgagcctgtgttgaagggggttaagctgcattacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12526 - RNA, 4094 nt, synthetic construct
  misc_feature 1..4094: note = SARS-CoV-2/Iceland/247/2020__EPI_ISL_417575 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctaagctccacagcctcagcactgggcaaactccaggacgtcgttaatcagaacgcgcaggccctgaatactcttgtgaagcaattgagcagtaactttggtgctatctcttccgtactgaatgacatattaagccgactcgataaggtggaagccgaggtccagatcgacagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggatttctgtggcaaaggttaccacctaatgtcctttccccaaagcgcgccacatggcgtcgtgttcctgcacgttacttatgtgccggcccaggagaagaattttaccacagctcctgcaatctgccacgacgggaaagcccatttccccagggaaggagtctttgtatctaacggcactcactggttcgtgacccagcgcaatttttacgagccacagataattacaacggataacaccttcgttagcgggaattgtgacgtggtcatcggaatcgtgaacaatactgtatatgatcccctccaacctgagctggactccttcaaggaagaacttgataaatactttaagaaccatacatcaccagacgtggatttgggcgacattagtggtatcaatgccagcgtcgttaacattcagaaggaaatagatcgactgaatgaggtggctaaaaacttaaacgaatctctcatcgacctgcaggagcttgggaagtatgagcagtacattaaatggccctggtatatctggctgggattcattgcaggcctaatcgccatagtgatcgtcaccattatgctctgctgtatgacttcctgctgttcatgcctgaagggttgttgcagttgtggcagctgctgcaaatttgacgaagatgactccgagcctgtgttgaagggggttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12527 - RNA, 4094 nt, synthetic construct
  misc_feature 1..4094: note = SARS-CoV-2/Iceland/238/2020__EPI_ISL_417566 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgtcggcttcataaaacaatacggggattgtcttggagacatcgccgcacgtgatttgatttgcgcccagaagttcaacggcctgaccgtgctgcccccactcttaacagacgaaatgatcgctcagtatacgtcagccctgcttgcaggtaccattacgagtgggtggacatttggcgctggagccgcgttgcagatccctttcgccatgcaaatggcttaccggtttaatggcataggggtgacccagaacgtcctctatgagaatcagaaactgattgcaaaccagttcaactccgccatcggaaagattcaagattctctaagctccacagcttcagccctgggcaaactccaggacgttgtgaatcagaacgcacaggcgctgaatactcttgtaaagcaattgagcagtaactttggtgccatctcttccgtgctgaatgacatattaagccgactcgataaggtcgaagctgaggtgcagatcgacagactgattaccgggaggcttcagtcgctgcaaacgtacgttacacagcagttgatccgcgccgcagagattcgggcttcagccaacctcgcagccaccaaaatgtctgaatgcgtgctgggacagagtaagagagtcgatttctgtggcaaaggttaccacctaatgtcctttccccaaagcgctccacatggcgtggttttcctgcacgtgacttatgtcccggcgcaggagaagaattttaccacagcccctgcaatctgccacgacgggaaagctcatttccccagggaaggagtatttgtgtctaacggcactcactggttcgttacccagcgcaatttttacgagccacagataattacaacggataacaccttcgtgagcgggaattgtgacgtcgtgatcggaatcgtaaacaatactgtgtatgatcccctccaacctgagctggactccttcaaggaagaacttgataaatactttaagaaccatacatcaccagacgtcgatttgggcgacattagtggtatcaatgccagcgttgtgaacattcagaaggaaatagatcgactgaatgaggtggccaaaaacttaaacgaatctctcatcgacctgcaggagcttgggaagtatgagcagtacattaaatggccctggtatatctggctgggattcattgctggcctaatcgcaatagtcatggtgaccatcatgctctgctgtatgacttcctgctgttcatgcctgaagggttgttgcagttgtggcagctgctgcaaatttgacgaagatgactccgagcctgttttgaagggggtaaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12528 - RNA, 4094 nt, synthetic construct
  misc_feature 1..4094: note = SARS-CoV-2/Greece/16/2020__EPI_ISL_418265 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacgttgatgggtacttcaaaatttacagtaagcacaccccaatcaatttagtgagggacctgccccagggatttagcgctcttgagcctttggtagatctgccaataggcatcaacattacacggttccagactctactcgccctgcatcgctcttatcttaccccgggcgactcctcaagcgggtggacagcaggagccgctgcatactatgtgggttacctgcaacccagaacctttttgctcaaatataatgaaaacggcacgatcactgatgccgtcgactgcgctctggatcctttaagtgagacaaagtgtaccctgaagtctttcactgtggaaaaagggatttaccagacatccaattttagggttcagccaaccgagagcatcgtgcggttccccaacataacgaatctctgcccttttggagaggtcttcaacgccacccgcttcgcgtcggtgtatgcatggaatcgaaagagaatttctaactgtgtagccgactactccgttctttacaattcagctagttttagcacattcaaatgctatggcgtgtccccaactaagctgaacgacttgtgttttaccaatgtctacgccgattctttcgtgatcaggggtgacgaagtccggcagattgcacccgggcaaacaggaaaaatcgctgattataactacaagctaccggacgattttactggctgcgtgatcgcctggaatagcaacaacctggactcaaaagttggcgggaattataactacctctatcgtctgttccgcaagagtaatcttaagccttttgagagagatatttccaccgaaatataccaggcgggaagcacaccctgtaacggtgtggagggcttcaattgctactttccactgcagtcttatgggttccaacctaccaacggagtaggctaccagccctatagggtcgtggttttgtcatttgaactcctgcacgccccagcaactgtgtgcggtcccaaaaagagtacgaatttagtcaaaaacaagtgtgtgaatttcaactttaatgggctgacaggcaccggagtactaactgagagcaacaaaaagttcctccctttccagcagtttggccgggacatcgctgataccacagacgccgtgcgagatccacaaaccctggagattcttgacatcactccgtgctccttcgggggagtttctgtcataacacccggtacgaatacctcgaaccaggtggctgtgttgtaccaggacgtcaattgtactgaagttcctgtggccattcacgcagatcagctgacaccaacctggcgcgtgtatagcacaggctccaacgtatttcaaactagagccgggtgcctcatcggagctgagcatgtcaacaattcatacgaatgtgacatccccattggcgcgggtatctgcgcaagttatcagacccagacgaactctcctaggcgggcccgcagcgtggcttcccagtcaattatagcctacaccatgagcctgggggcagaaaattctgttgcctactccaacaatagtatcgctattccaacaaacttcactatcagcgtgaccacagaaatccttcccgtctctatgactaagacctccgtggattgtacgatgtatatttgcggcgactcaacagagtgtagtaatctgttgctccaatacggcagcttttgcacccagctgaacagagccttaactggaatagcagttgagcaggataaaaatacacaggaagtgttcgcgcaagtaaagcagatctataaaaccccgcctattaaggactttgggggattcaacttttcgcagatcctgccagatccctccaaaccttctaagaggagcttcattgaggacctactctttaataaggtcactctggctgatgccggtttcatcaaacaatacggcgactgtcttggggatatagcagcccgtgacttgatctgcgctcagaagttcaacggactgaccgtgctgcccccactcttaacagatgaaatgattgcccagtatacgtcagcactgcttgctggcaccatcacgagtggttggacatttggggccggcgcggccttgcagattcctttcgctatgcaaatggcataccggtttaatggaatcggcgtgacccagaacgtcctctatgagaatcagaaactgatagccaaccagttcaactccgctattgggaagatccaagactctctaagctccacagcctcagcactgggaaaactccaggacgttgtgaatcagaacgcgcaggccctgaatactcttgtaaagcaattgagcagtaactttggcgctatttcttccgtgctgaatgatatcttaagccgactcgacaaggtcgaagccgaggtgcagatagatagactgatcaccggtaggcttcagtcgctgcaaacgtacgttacacagcagttgattcgcgcagctgagatccgggcctcagcaaacctcgccgctaccaaaatgtctgaatgcgtgctggggcagagtaagagagtcgacttctgtggaaaaggctaccacctaatgtcctttccccaaagcgcgccacatggtgtggttttcctgcacgtgacttatgtcccggcccaggagaagaattttaccacagctcctgcaatttgccacgatggcaaagcccatttccccagggaaggggtatttgtgtctaacggaactcactggttcgttacccagcgcaatttttacgagccacagatcataacaacggacaacaccttcgtgagcggcaattgtgatgtcgtgattgggatcgtaaacaatactgtgtatgaccccctccaacctgagctggattccttcaaggaggaacttgacaaatactttaagaaccatacatcaccagatgtcgacttgggagatatcagtggcattaatgccagcgttgtgaacatccagaaggaaattgaccgactgaatgaggtggctaaaaacttaaacgaatctctcatagacctgcaggagcttggtaagtatgagcagtacatcaaatggccctggtatatttggctggggttcatcgcaggactaattgccatcgtcatggtgaccataatgctctgctgtatgacttcctgctgttcatgcctgaagggctgttgcagttgtggtagctgctgcaaatttgatgaagacgattccgagcctgttttgaagggcgtaaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12529 - RNA, 4094 nt, synthetic construct
  misc_feature 1..4094: note = SARS-CoV-2/Iceland/319/2020__EPI_ISL_417648 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgattgacctggaaggcaagcagggtaattttaaaaacctcagagagttcgtctttaagaacatcgatgggtacttcaaaatatacagtaagcacaccccaatcaatttagttagggacctgccccagggatttagcgctcttgagcctttggtggatctgccaattggcatcaacattacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgatcactgatgccgtggactgcgctctggatcctttaagtgagacaaagtgtaccctgaagtctttcactgtcgaaaaagggatataccagacatccaattttagggtgcagccaaccgagagcattgttcggttccccaacatcacgaatctctgcccttttggagaggtgttcaacgccacccgcttcgcgtcggtctatgcatggaatcgaaagagaatttctaactgtgtggccgactactccgtactttacaattcagctagttttagcacattcaaatgctatggcgtttccccaactaagctgaacgacttgtgttttaccaatgtgtacgccgattctttcgtcatcaggggtgacgaagtgcggcagatcgcacccgggcaaacaggaaaaattgctgattataactacaagctaccggacgattttactggctgcgtcatagcctggaatagcaacaacctggactcaaaagtgggcgggaattataactacctctatcgtctgttccgcaagagtaatcttaagccttttgagagagatatctccaccgaaatttaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacatcgctgataccacagacgccgtacgagatccacaaaccctggagatacttgacattactccgtgctccttcgggggagtgtctgttatcacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcattggcgctgagcatgtaaacaattcatacgaatgtgatatccccattggtgcggggatatgcgcaagttatcagacccagacgaactctcctaggcgggcccgcagcgtcgcttcccagtcaatcattgcctacaccatgagcctgggcgcagaaaattctgtggcctactccaacaatagtatcgctatcccaacaaacttcactattagcgttaccacagaaatacttcccgtgtctatgactaagacctccgtcgactgtacgatgtatatctgcggagattcaacagagtgtagtaatctgttgctccaatacggcagcttttgcacccagctgaacagagccttaactgggattgcagtggagcaggacaaaaatacacaggaagttttcgcgcaagtgaagcagatctataaaaccccgcctattaaggattttggaggtttcaacttttcgcagatcctgccagacccctccaaaccttctaagaggagcttcatagaggatctactctttaataaggtaactctggctgacgccggcttcatcaaacaatacggggattgtcttggagacattgcagcccgtgatttgatctgcgctcagaagttcaacggcctgaccgtcctgcccccactcttaacagacgaaatgattgcccagtatacgtcagcactgcttgctggtaccatcacgagtgggtggacatttggcgccggagcggccttgcagatacctttcgctatgcaaatggcataccggtttaatggcattggggtgacccagaacgtgctctatgagaatcagaaactgatcgccaaccagttcaactccgctattggaaagatccaagattctctaagctccacagcctcagcactgggcaaactccaggacgtcgttaatcagaacgcgcaggccctgaatactcttgtgaagcaattgagcagtaactttggtgctatatcttccgtactgaatgacatcttaagccgactcgataaggtggaagccgaggtccagattgacagactgatcaccgggaggcttcagtcgctgcaaacgtacgtgacacagcagttgattcgcgcagctgagatccgggcctcagcaaacctcgccgctaccaaaatgtctgaatgcgttctgggacagagtaagagagtggatttctgtggcaaaggttaccacctaatgtcctttccccaaagcgcgccacatggcgtcgtgttcctgcacgttacttatgtgccggcccaggagaagaattttaccacagctcctgcaatatgccacgacgggaaagcccatttccccagggaaggagtctttgtatctaacggcactcactggttcgtgacccagcgcaatttttacgagccacagattatcacaacggataacaccttcgttagcgggaattgtgacgtggtcatcggaattgtgaacaatactgtatatgatcccctccaacctgagctggactccttcaaggaagaacttgataaatactttaagaaccatacatcaccagacgtggatttgggcgacatcagtggtattaatgccagcgtcgttaacatacagaaggaaatcgatcgactgaatgaggtggctaaaaacttaaacgaatctctcattgacctgcaggagcttgggaagtatgagcagtacatcaaatggccctggtatatttggctgggattcatcgcaggcctaatagccatcgtgatggtcaccattatgctctgctgtatgacttcctgctgttcatgcctgaagggttgttgcagttgtggcagctgctgcaaatttgacgaagatgactccgagcctgtgttgaagggggttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12530 - RNA, 4094 nt, synthetic construct
  misc_feature 1..4094: note = SARS-CoV-2/Congo/94/2020__EPI_ISL_417947 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatatactatttaataaggtaactctcgctgacgccggcttcatcaaacaatacggggattgtctgggagacattgcagcccgtgatcttatctgcgctcagaagttcaacggcttgaccgtcctgcccccactcctgacagacgaaatgattgcccagtatacgtcagcattactggctggtaccatcacgagtgggtggacatttggcgccggagcggcccttcagatacctttcgctatgcaaatggcataccggtttaatggcattggggtgacccagaacgtgttgtatgagaatcagaaactcatcgccaaccagttcaactccgctattggaaagatccaagattctctgagctccacagcctcagcactaggcaaactgcaggacgtcgttaatcagaacgcgcaggccctcaatactctggtgaagcaacttagcagtaactttggtgctatatcttccgtattgaatgacatcctgagccgattagataaggtggaagccgaggtccagattgacagactcatcaccgggaggctgcagtcgcttcaaacgtacgtgacacagcagctgattcgcgcagctgagatccgggcctcagcaaacttggccgctaccaaaatgtctgaatgcgttctcggacagagtaagagagtggatttctgtggcaaaggttaccacctgatgtcctttccccaaagcgcgccacatggcgtcgtgttcctacacgttacttatgtgccggcccaggagaagaattttaccacagctcctgcaatatgccacgacgggaaagcccatttccccagggaaggagtctttgtatctaacggcactcactggttcgtgacccagcgcaatttttacgagccacagattatcacaacggataacaccttcgttagcgggaattgtgacgtggtcatcggaattgtgaacaatactgtatatgatcccctgcaacctgagctcgactccttcaaggaagaactggataaatactttaagaaccatacatcaccagacgtggatcttggcgacatcagtggtattaatgccagcgtcgttaacatacagaaggaaatcgatcgattgaatgaggtggctaaaaacctgaacgaatctttaattgacctccaggagctggggaagtatgagcagtacatcaaatggccctggtatatttggcttggattcatcgcaggcctgatagccatcgtgatggtcaccattatgctatgctgtatgacttcctgctgttcatgcctcaagggttgttgcagttgtggcagctgctgcaaatttgacgaagatgactccgagcctgtgctgaagggggttaagttgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12531 - RNA, 4094 nt, synthetic construct
  misc_feature 1..4094: note = SARS-CoV-2/Congo/158/2020__EPI_ISL_417950 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcctcagcggcaattgtgatgttgtgatcgggatcgtcaacaatactgtgtatgaccccctgcaacctgagcttgattccttcaaggaagagttggacaaatactttaagaaccatacatcaccagatgtagacctgggagatattagtggcatcaatgccagcgtggtcaacattcagaaggaaatagaccgattaaatgaggttgctaaaaacctcaacgaatctctgatcgaccttcaggagctgggtaagtatgagcagtacattaaatggccctggtatatctggctagggttcattgcaggactcatcgccatagtgatggtgaccatcatgctgtgctgtatgacttcctgctgttcatgcttgaagggctgttgcagttgtggtagctgctgcaaatttgatgaagacgattccgagcctgtcctgaagggcgtgaagttacactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12532 - RNA, 4094 nt, synthetic construct
  misc_feature 1..4094: note = SARS-CoV-2/USA/UT-00034/2020__EPI_ISL_417977 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactattacaaaaataacaagtcctggatggagtctgagttccgtgtgtatagctccgcgaataactgtacttttgagtacgtgtcacaacctttcctgatggacctggaaggcaagcagggtaattttaaaaacctcagagagttcgtctttaagaacattgatgggtacttcaaaatctatagtaagcataccccaataaatttagttagggacctgccccagggatttagcgctcttgagcctttggtggatctgccaatcggcattaacatcacacggttccagactctactcgccctgcaccgctcttaccttaccccgggcgactcctcaagcgggtggacagcaggagccgctgcatattacgtaggttatctgcaacccagaacctttttgctcaaatacaatgaaaacggcacgattactgatgccgtggactgcgctctggatcctttaagtgagacaaagtgtaccctgaagtctttcactgtcgaaaaagggatctatcagacatccaattttagggtgcagccaaccgagagcatagttcggttccccaacattacgaatctctgcccttttggagaggtgttcaacgccacccgcttcgcgtcggtctacgcatggaatcgaaagagaatctctaactgtgtggccgactactccgtactttataattcagctagttttagcacattcaaatgctacggcgtttccccaactaagctgaacgacttgtgttttaccaatgtgtatgccgattctttcgtcattaggggtgacgaagtgcggcagatcgcacccgggcaaacaggaaaaatcgctgattacaactataagctaccggacgattttactggctgcgtcattgcctggaatagcaacaacctggactcaaaagtgggcgggaattacaactatctctaccgtctgttccgcaagagtaatcttaagccttttgagagagatatatccaccgaaatctaccaggcgggaagcacaccctgtaacggtgttgagggcttcaattgctattttccactgcagtcttacgggttccaacctaccaacggagtgggctatcagccctacagggtagtcgtgttgtcatttgaactcctgcatgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtatcagggcgtgaattgtactgaagtccctgttgccatccacgcagaccagctgacaccaacctggcgcgtgtacagcacagggtccaacgtgtttcaaactagagccggatgcctcatcggcgctgagcacgtaaacaattcatatgaatgtgatattcccatcggtgcggggatttgcgcaagttaccagacccagacgaactctcctaggcgggcccgcagcgtcgcttcccagtcaataatcgcctacaccatgagcctgggcgcagaaaattctgtggcctattccaacaatagtattgctatcccaacaaacttcactatcagcgttaccacagaaattcttcccgtgtctatgactaagacctccgtcgactgtacgatgtacatatgcggagattcaacagagtgtagtaatctgttgctccaatatggcagcttttgcacccagctgaacagagccttaactgggatcgcagtggagcaggacaaaaatacacaggaagttttcgcgcaagtgaagcagatttacaaaaccccgcctatcaaggattttggaggtttcaacttttcgcagattctgccagacccctccaaaccttctaagaggagcttcatcgaggatctactctttaataaggtaactctggctgacgccggcttcataaaacaatatggggattgtcttggagacatcgcagcccgtgatttgatttgcgctcagaagttcaacggcctgaccgtcctgcccccactcttaacagacgaaatgatcgcccagtacacgtcagcactgcttgctggtaccattacgagtgggtggacatttggcgccggagcggccttgcagatccctttcgctatgcaaatggcatatcggtttaatggcataggggtgacccagaacgtgctctacgagaatcagaaactgattgccaaccagttcaactccgctatcggaaagattcaagattctctaagctccacagcctcagcactgggcaaactccaggacgtcgttaatcagaacgcgcaggccctgaatactcttgtgaagcaattgagcagtaactttggtgctatctcttccgtactgaatgacatattaagccgactcgataaggtggaagccgaggtccagatcgacagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggatttctgtggcaaaggttatcatctaatgtcctttccccaaagcgcgccacacggcgtcgtgttcctgcatgttacttacgtgccggcccaggagaagaattttaccacagctcctgcaatctgccacgacgggaaagcccacttccccagggaaggagtctttgtatctaacggcactcattggttcgtgacccagcgcaatttttatgagccacagataattacaacggataacaccttcgttagcgggaattgtgacgtggtcatcggaatcgtgaacaatactgtatacgatcccctccaacctgagctggactccttcaaggaagaacttgataaatattttaagaaccacacatcaccagacgtggatttgggcgacattagtggtatcaatgccagcgtcgttaacattcagaaggaaatagatcgactgaatgaggtggctaaaaacttaaacgaatctctcatcgacctgcaggagcttgggaagtacgagcagtatattaaatggccctggtacatctggctgggattcattgcaggcctaatcgccatagtgatggtcaccatcatgctctgctgtatgacttcctgctgttcatgcctgaagggttgttgcagttgtggcagctgctgcaaatttgacgaagatgactccgagcctgtgttgaagggggttaagctgcattacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12533 - RNA, 4094 nt, synthetic construct
  misc_feature 1..4094: note = SARS-CoV-2/USA/UT-00033/2020__EPI_ISL_417976 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggctgacagcaggagccgctgcatactatgtaggttacttgcaacccagaacctttctcctgaaatataatgaaaacggcacgattactgatgccgtggactgcgctttagatcctctgagtgagacaaagtgtaccctcaagtctttcactgtcgaaaaagggatctaccagacatccaattttagggtgcagccaaccgagagcatagttcggttccccaacattacgaatctttgcccttttggagaggtgttcaacgccacccgcttcgcgtcggtctatgcatggaatcgaaagagaatctctaactgtgtggccgactactccgtactgtacaattcagctagttttagcacattcaaatgctatggcgtttccccaactaagttgaacgacctatgttttaccaatgtgtacgccgattctttcgtcattaggggtgacgaagtgcggcagatcgcacccgggcaaacaggaaaaatcgctgattataactacaagctgccggacgattttactggctgcgtcattgcctggaatagcaacaacctcgactcaaaagtgggcgggaattataactacctgtatcgtcttttccgcaagagtaatctgaagccttttgagagagatatatccaccgaaatctaccaggcgggaagcacaccctgtaacggtgttgagggcttcaattgctactttccattgcagtcttatgggttccaacctaccaacggagtgggctaccagccctatagggtagtcgtgctctcatttgaactgttacacgccccagcaactgtttgcggtcccaaaaagagtacgaatctggtgaaaaacaagtgtgtcaatttcaactttaatgggctaacaggcaccggagtgctcactgagagcaacaaaaagttcctgcctttccagcagtttggccgggacattgctgataccacagacgccgtacgagatccacaaacccttgagatcttggacataactccgtgctccttcgggggagtgtctgttattacacccggtacgaatacctcgaaccaggtcgctgtgctgtaccagggcgtgaattgtactgaagtccctgttgccatccacgcagaccagctcacaccaacctggcgcgtgtatagcacagggtccaacgtgtttcaaactagagccggatgcctgatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagccttggcgcagaaaattctgtggcctactccaacaatagtattgctatcccaacaaacttcactatcagcgttaccacagaaattctgcccgtgtctatgactaagacctccgtcgactgtacgatgtatatatgcggagattcaacagagtgtagtaatttgctcctgcaatacggcagcttttgcacccagttaaacagagccctgactgggatcgcagtggagcaggacaaaaatacacaggaagttttcgcgcaagtgaagcagatttataaaaccccgcctatcaaggattttggaggtttcaacttttcgcagattctaccagacccctccaaaccttctaagaggagcttcatcgaggatctcctgtttaataaggtaactcttgctgacgccggcttcataaaacaatacggggattgtttgggagacatcgcagcccgtgatctgatttgcgctcagaagttcaacggcctcaccgtcctgcccccattactgacagacgaaatgatcgcccagtatacgtcagcacttttggctggtaccattacgagtgggtggacatttggcgccggagcggccctccagatccctttcgctatgcaaatggcataccggtttaatggcataggggtgacccagaacgtgctgtatgagaatcagaaactaattgccaaccagttcaactccgctatcggaaagattcaagattctctgagctccacagcctcagcactcggcaaactgcaggacgtcgttaatcagaacgcgcaggcccttaatactttggtgaagcaactgagcagtaactttggtgctatctcttccgtattaaatgacatactcagccgactggataaggtggaagccgaggtccagatcgacagacttattaccgggaggctgcagtcgttgcaaacgtacgtgacacagcagctcatccgcgcagctgagattcgggcctcagcaaacctggccgctaccaaaatgtctgaatgcgttctaggacagagtaagagagtggatttctgtggcaaaggttaccacctgatgtcctttccccaaagcgcgccacatggcgtcgtgttcctccacgttacttatgtgccggcccaggagaagaattttaccacagctcctgcaatctgccacgacgggaaagcccatttccccagggaaggagtctttgtatctaacggcactcactggttcgtgacccagcgcaatttttacgagccacagataattacaacggataacaccttcgttagcgggaattgtgacgtggtcatcggaatcgtgaacaatactgtatatgatcccctgcaacctgagcttgactccttcaaggaagagttggataaatactttaagaaccatacatcaccagacgtggatctgggcgacattagtggtatcaatgccagcgtcgttaacattcagaaggaaatagatcgattaaatgaggtggctaaaaacctcaacgaatctctgatcgaccttcaggagctggggaagtatgagcagtacattaaatggccctggtatatctggctaggattcattgcaggcctcatcgccatagtgatggtcaccatcatgctgtgctgtatgacttcctgctgttcatgcttgaagggttgttgcagttgtggcagctgctgcaaatttgacgaagatgactccgagcctgtgctgaagggggttaagttacactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12534 - RNA, 4094 nt, synthetic construct
  misc_feature 1..4094: note = SARS-CoV-2/USA/WI-13/2020__EPI_ISL_417516 spike protein mRNA human (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgctcccaaccgagagcatagttcggttccccaacattacgaatctttgcccttttggagaggtgttcaacgccacccgcttcgcgtcggtctatgcatggaatcgaaagagaatctctaactgtgtggccgactactccgtactgtacaattcagctagttttagcacattcaaatgctatggcgtttccccaactaagttgaacgacctatgttttaccaatgtgtacgccgattctttcgtcattaggggtgacgaagtgcggcagatcgcacccgggcagacaggaaaaatcgctgattataactacaagctgccggacgattttactggctgcgtcattgcctggaatagcaacaacctcgactcaaaagtgggcgggaattataactacctgtatcgtcttttccgcaagagtaatctgaagccttttgagagagatatatccaccgaaatctaccaagcgggaagcacaccctgtaacggtgttgagggcttcaattgctactttccattgcagtcttatgggttccagcctaccaacggagtgggctaccaaccctatagggtagtcgtgctctcatttgaactgttacacgccccagcaactgtttgcggtcccaaaaagagtacgaatctggtgaaaaacaagtgtgtcaatttcaactttaatgggctaacaggcaccggagtgctcactgagagcaacaaaaagttcctgcctttccagcagtttggccgggacattgctgataccacagacgccgtacgagatccacagacccttgagatcttggacataactccgtgctccttcgggggagtgtctgttattacacccggtacgaatacctcgaaccaagtcgctgtgctgtaccagggcgtgaattgtactgaagtccctgttgccatccacgcagaccagctcacaccaacctggcgcgtgtatagcacagggtccaacgtgtttcagactagagccggatgcctgatcggcgctgagcatgtaaacaattcatacgaatgtgatattcccatcggtgcggggatttgcgcaagttatcaaacccagacgaactctcctaggcgggcccgcagcgtcgcttcccagtcaataatcgcctacaccatgagccttggcgcagaaaattctgtggcctactccaacaatagtattgctatcccaacaaacttcactatcagcgttaccacagaaattctgcccgtgtctatgactaagacctccgtcgactgtacgatgtatatatgcggagattcaacagagtgtagtaatttgctcctgcagtacggcagcttttgcacccaattaaacagagccctgactgggatcgcagtggagcaggacaaaaatacacaggaagttttcgcacaggtgaagcaaatttataaaaccccgcctatcaaggattttggaggtttcaacttttcgcagattctaccagacccctccaaaccttctaagaggagcttcatcgaggatctcctgtttaataaggtaactcttgctgacgccggcttcataaaacagtacggggattgtttgggagacatcgcagcccgtgatctgatttgcgctcaaaagttcaacggcctcaccgtcctgcccccattactgacagacgaaatgatcgcccagtatacgtcagcacttttggctggtaccattacgagtgggtggacatttggcgccggagcggccctccagatccctttcgctatgcagatggcataccggtttaatggcataggggtgacccaaaacgtgctgtatgagaatcagaaactaattgccaaccagttcaactccgctatcggaaagattcaggattctctgagctccacagcctcagcactcggcaaactgcaagacgtcgttaatcagaacgcgcaggcccttaatactttggtgaagcagctgagcagtaactttggtgctatctcttccgtattaaatgacatactcagccgactggataaggtggaagccgaggtccaaatcgacagacttattaccgggaggctgcagtcgttgcagacgtacgtgacacaacagctcatccgcgcagctgagattcgggcctcagcaaacctggccgctaccaaaatgtctgaatgcgttctaggacagagtaagagagtggatttctgtggcaaaggttaccacctgatgtcctttccccagagcgcgccacatggcgtcgtgttcctccacgttacttatgtgccggcccaagagaagaattttaccacagcgcctgctatctgccacgacgggaaagcccatttccccagggaaggagtctttgtatctaacggcactcactggttcgtgacccagcgcaatttttacgagccacagataattacaacggataacaccttcgttagcgggaattgtgacgtggtcatcggaatcgtgaacaatactgtatatgatcccctgcagcctgagcttgactccttcaaggaagagttggataaatactttaagaaccatacatcaccagacgtggatctgggcgacattagtggtatcaatgccagcgtcgttaacattcaaaaggaaatagatcgattaaatgaggtggctaaaaacctcaacgaatctctgatcgaccttcaggagctggggaagtatgagcagtacattaaatggccctggtatatctggctaggattcattgcaggcctcatcgccatagtgatggtcaccatcatgctgtgctgtatgacttcctgctgttcatgcttgaagggttgttgcagttgtggcagctgctgcaaatttgacgaagatgactccgagcctgtgctgaagggggttaagttacactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12535 - RNA, 4091 nt, synthetic construct
  misc_feature 1..4091: note = SARS-CoV-2/India/1-27/2020__EPI_ISL_413522 spike protein mRNA human (1-1272)
  source 1..4091: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacacgaatagcttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctaccataaaaataacaagtcctggatggagtctgagttccgtgtgtatagctccgcgaataactgtacttttgaatacgtgtcacaacctttcctgatggacctggaaggcaagcagggtaattttaaaaacctcagagagttcgtctttaagaacattgatgggtatttcaaaatctacagtaagcacaccccaataaatttagttagggacctgccccagggatttagcgctcttgagcctttggtggatctgccaatcggcattaacatcacacggttccagactctactcgccctgcatcgctcttaccttaccccgggcgactcctcaagcgggtggacagcaggagccgctgcatattacgtaggttatctgcaacccagaacctttttgctcaaatacaatgaaaacggcacgattactgatgccgtggactgcgctctggatcctttaagtgagacaaagtgtaccctgaagtctttcactgtcgaaaaagggatctatcagacatccaattttagggtgcagccaaccgagagcatagttcggttccccaacattacgaatctctgcccttttggagaggtgttcaacgccacccgcttcgcgtcggtctacgcatggaatcgaaagagaatctctaactgtgtggccgactattccgtactttacaattcagctagttttagcacattcaaatgctacggcgtttccccaactaagctgaacgacttgtgttttaccaatgtgtatgccgattctttcgtcattaggggtgacgaagtgatccagatcgcacccgggcaaacaggaaaaattgctgattacaactataagctaccggacgattttactggctgcgtcatagcctggaatagcaacaacctggactcaaaagtgggcgggaattacaactatctctaccggctgttccgtaagagtaatcttaagccttttgagcgcgatatctccaccgaaatttatcaggcgggaagcacaccctgtaacggtgttgagggcttcaattgctactttccactgcagtcttacgggttccaacctaccaacggagtgggctatcagccctacagagtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggcagggacatcgctgataccacagacgccgtacgggatccacaaaccctggagatacttgacattactccgtgctccttcgggggagtgtctgttatcacacccggtacgaatacctcgaaccaggtcgctgtgttgtatcaggacgtgaattgtactgaagtccctgttgccatccacgcagatcagctgacaccaacctggcgagtgtacagcacaggctccaacgtgtttcaaactcgcgccgggtgcctcattggagctgagcatgtaaacaattcatatgaatgtgacatccccattggcgcgggtatatgcgcaagttaccagacccagacgaactctcctagaagggcccggagcgtcgcttcccagtcaatcattgcctataccatgagcctgggggcagaaaattctgtggcctactccaacaatagtatcgctatcccaacaaacttcactattagcgttaccacagaaatacttcccgtgtctatgactaagacctccgtcgattgtacgatgtacatctgcggcgactcaacagagtgtagtaatctgttgctccaatatggatctttttgcacccagctgaaccgcgccttaactggcattgcagtggagcaggataaaaatacacaggaagttttcgcgcaagtgaagcagatctacaaaaccccgcctattaaggactttgggggattcaacttttcgcagatcctgccagatccctccaaaccttctaagagaagtttcatagaggacctactctttaataaggtaactctggctgatgccggtttcatcaaacaatatggcgactgtcttggggatattgcagccagggacttgatctgcgctcagaagttcaacggactgaccgtcctgcccccactcttaacagatgaaatgattgcccagtacacgtcagcactgcttgctggcaccatcactagcggttggacatttggggccggcgcggccttgcagatacctttcgctatgcaaatggcatatcgttttaatggaattggcgtgacccagaacgtgctctacgagaatcagaaactgatcgccaaccagttcaactccgctattgggaagatccaagactctctaagctccacagcctcagcactgggaaaactccaggacgtcgttaatcagaacgcgcaggccctgaatactcttgtgaagcaattgagcagtaactttggcgctatatcttccgtactgaatgatatcttaagccggctcgacaaggtggaagccgaggtccagattgatcgactgatcaccggtagacttcagtcgctgcaaacgtatgtgacacagcagttgattagggcagctgagatccgcgcctcagcaaacctcgccgctaccaaaatgtctgaatgcgttctggggcagagtaagcgggtggacttctgtggaaaaggctaccacctaatgtcctttccccaaagcgcgccacatggtgtcgtgttcctgcacgttacttacgtgccggcccaggagaagaattttaccacagctcctgcaatatgccacgatggcaaagcccatttccccagagaaggggtctttgtatctaacggaactcactggttcgtgacccagaggaatttttatgagccacagattatcacaacggacaacaccttcgttagcggcaattgtgatgtggtcatcgggattgtgaacaatactgtatacgaccccctccaacctgagctggattccttcaaggaggaacttgacaaatattttaagaaccatacatcaccagatgtggacttgggagatatcagtggcattaatgccagcgtcgttaacatacagaaggaaatcgaccgcctgaatgaggtggctaaaaacttaaacgaatctctcattgacctgcaggagcttggtaagtacgagcagtatatcaaatggccctggtacatttggctggggttcatcgcaggactaatagccatcgtgatggtcaccattatgctctgctgtatgacttcctgctgttcatgcctgaagggctgttgcagttgtggtagctgctgcaaatttgatgaagacgattccgagcctgtgttgaagggcgttaagctgcactatacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12536 - RNA, 4076 nt, synthetic construct
  misc_feature 1..4076: note = SARS-CoV-2/pangolin/Guangxi/P4L/2017__EPI_ISL_410538 spike protein mRNA human (1-1267)
  source 1..4076: mol_type = other RNA
aggagagtcccgcagtcggcgtccagcggctctgcttgttcgtgtgtgtgtcgttgcaggccttattcaagcttaccatgttcgtgtttctgttcgtcctcccccttgttagctcccagtgcgtgaacctgaccacaagaactggcatccctccagggtacacgaatagctcaaccaggggagtatattacccggacaaggtgtttcggagtagcattttgcacttaacacaagatctgttcctaccctttttctccaacgtcacttggtttaataccataaactatcagggtggcttcaaaaagtttgacaatcctgtgctcccattcaacgatggggtttactttgcctctacagagaaatcgaatatcattcgcggatggatcttcggcaccactctggacgctcgaacacagtcacttctgattgtgaacaatgcaaccaacgtcgtgatcaaggtatgtgaatttcagttctgcacggatcccttcttgggtgtttattaccataataacaataaaacttgggtggagaacgaatttcgtgtctatagcagtgccaataactgtaccttcgagtacatatcccaaccttttctcatggacctggaagggaagcagggaaacttcaagaatctgagagagtttgtgttcaaaaacgtggatggctactttaagatctattctaaacacacaccaattgacctcgtcagggatttaccccggggcttcgcggctctggagcctcttgttgacttgccaatcgggattaatatcactcgctttcagaccctgctagccctccatagaagctacctgacaccgggaaaccttgaatccggttggaccacgggcgcagccgcttattacgtggggtatctgcagcaaaggactttcttgctctcatacaatcagaacggaacaataaccgatgcagtagactgcagtctggatcccttaagcgagactaagtgtacactgaaatctctcaccgtggaaaagggcatttatcagacgtccaattttcgggtccagcctaccatctcaattgtgcgcttcccaaacatcacaaatctttgcccctttggtgaggttttcaacgccagcaagttcgctagtgtgtacgcctggaatcgaaaaagaatctctaactgtgtcgcggactactccgtgctgtataatagcacttcgttttctaccttcaagtgctacggggtatcccctacaaaattgaacgacctatgttttactaatgtttatgcagattcattcgtggtcaagggagacgaggtgaggcaaattgccccaggccagaccggcgtcatagctgattacaactataaactgcccgacgattttacagggtgcgtgatcgcctggaacagtgttaagcaggacgcactcaccggaggtaattacggctatctgtaccggcttttccgtaaaagcaagctgaagccgtttgaacgcgatatttccactgagatctaccaagctgggtctacgccttgtaacggacaggtgggcttgaattgctattaccccctcgaaagatatggtttccacccaacaaccggggtaaactaccagccttttagggtcgtggttctgagcttcgagttactgaatggccccgccactgtgtgcggaccaaaactatcaaccacactcgtcaaggacaaatgtgtgaactttaatttcaacggcctgaccgggactggagtacttacaacgagtaagaaacagtttttgcccttccaacagttcggtcgggatatatccgacaccactgatgcggtgcgagaccctcagacactggaaattctcgacatcaccccatgcagctttggcggggtttctgtcatcacaccgggaactaatacctcaaaccaggtggccgtgctgtatcaagatgtcaattgtacggaggttcccatggcaattcatgctgagcagcttacccctgcctggcgcgtgtacagtgctggcgccaacgtgttccagacaagagcaggttgcctggtaggggccgaacacgtcaataacagctatgagtgtgacatcccagtgggcgctggaatttgcgcgtcctaccactctatgtcgagcttgaggtccgttaatcagcggtcaataatcgcatacactatgagtctcggcgccgaaaactctgtggcttatagcaacaattccattgccatccccaccaactttacaatctcagtcactaccgagattctgcctgtgagcatgacgaagacatctgttgattgtaccatgtacatatgcggggactccatcgaatgtagtaatttactgctacaatatggatctttctgcactcagctcaaccgcgcactgacaggtattgccgtggagcaggataagaatacccaggaggtatttgctcaagtcaaacagatctacaagactccacccattaaagacttcggcgggtttaacttctctcagatccttccggatccttccaagccatcaaaaagaagttttatagaagacttgctgttcaataaggtgaccctcgccgatgcaggatttatcaagcaatatggcgactgtctgggtgatattgcggctagggacttaatctgcgcccagaaattcaacgggctgacagtgcttccccctttgctcacggatgagatgattgcacagtacaccagcgccctgctagctggcactatcacatcgggatggaccttcggcgccggggcagctctgcagataccctttgccatgcaaatggcgtatcgtttcaatggaattggcgtcacacagaacgttctctacgaaaatcagaagctgatcgccaaccagtttaattccgctattggtaaaatccaagactctcttagctcaactgcaagtgccttggggaagctgcaggacgtggtaaaccagaatgctcaggccttaaacaccctcgtgaaacaactgtcctctaacttcggagcaataagctccgtccttaatgatatcctgtcacggttggacaaggtggaggcggaagttcagattgatcgactcatcacgggcagactgcagagcctacaaacatacgtgacccagcagctgattagggccgctgagatccgcgccagtgcaaacctcgctgccactaagatgtctgagtgcgtcctgggtcagtccaaacgggtggacttttgtggcaaggggtatcatcttatgagcttcccacaatcggcacctcacggagttgtgtttttgcatgtcacctacgtacccgcccaggagaaaaatttcacaactgctccagcgatatgccacgagggcaaggcccactttccgagagaaggggtgttcgtttcaaacggaacccattggtttattacacagaggaatttctatgagcctcagatcatcacgaccgataacacttttgtgtctggcagttgtgacgtcgtgattggtatcgtaaataacacagtgtacgatcccctgcaaccagagttagactccttcaaagaagaactcgataagtatttcaaaaatcacaccagccccgacgtcgatctgggggacatttctggaataaacgcaagcgttgtgaatatccagaaggaaattgatcgccttaacgaggtggctaagaatctgaacgaatcccctatcgacctacaggagctcggcaaatacgagcagtatattaagtggccatggtacatctggctgggttttatagccggcttgatcgccattatcatggtcactattatgctgtgctgtatgacatcatgctgtagttgcttaaaagggtgttgcagctgtggatcttgctgcaagttcgacgaagatgactccgagcccgtgctcaaaggcgttaagctgcattacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12537 - RNA, 4076 nt, synthetic construct
  misc_feature 1..4076: note = SARS-CoV-2/pangolin/Guangxi/P5L/2017__EPI_ISL_410540 spike protein mRNA human (1-1267)
  source 1..4076: mol_type = other RNA
aggagagtcccgcagtcggcgtccagcggctctgcttgttcgtgtgtgtgtcgttgcaggccttattcaagcttaccatgttcgtgtttctgttcgtcctcccccttgttagctcccagtgcgtgaacctgaccacaagaactggcatccctccagggtacacgaatagctcaaccaggggagtatattacccggacaaggtgtttcggagtagcattttgcacttaacacaagatctgttcctaccctttttctccaacgtcacttggtttaataccataaactatcagggtggcttcaaaaagtttgacaatcctgtgctcccattcaacgatggggtttactttgcctctacagagaaatcgaatatcattcgcggatggatcttcggcaccactctggacgctcgaacacagtcacttctgattgtgaacaatgcaaccaacgtcgtgatcaaggtatgtgaatttcagttctgcacggatcccttcttgggtgtttattaccataataacaataaaacttgggtggagaacgaatttcgtgtctatagcagtgccaataactgtaccttcgagtacatatcccaaccttttctcatggacctggaagggaagcagggaaacttcaagaatctgagagagtttgtgttcaaaaacgtggatggctactttaagatctattctaaacacacaccaattgacctcgtcagggatttaccccggggcttcgcggctctggagcctcttgttgacttgccaatcgggattaatatcactcgctttcagaccctgctagccctccatagaagctacctgacaccgggaaaacttgaatccggttggaccacgggcgcagccgcttattacgtggggtatctgcagcaaaggactttcttgctctcatacaaccagaatggaacaataaccgatgcagtagactgcagtctggatcccttaagcgagactaagtgtacactgaagtctctcaccgtggaaaagggcatttatcagacgtccaactttcgggtccagcctaccatctcaattgtgcgcttcccaaatatcacaaacctttgcccctttggtgaggttttcaatgccagcaaattcgctagtgtgtacgcctggaaccgaaagagaatctctaattgtgtcgcggactactccgtgctgtataacagcacttcgttttctaccttcaaatgctacggggtatcccctacaaagttgaatgacctatgttttactaacgtttatgcagattcattcgtggtcaaaggagacgaggtgaggcaaattgccccaggccagaccggcgtcatagctgattacaattataagctgcccgacgattttacagggtgcgtgatcgcctggaacagtgttaaacaggacgcactcaccggaggtaactacggctatctgtaccggcttttccgtaagagcaagctgaaaccgtttgaacgcgatatttccactgagatctaccaagctgggtctacgccttgtaatggacaggtgggcttgaactgctattaccccctcgaaagatatggtttccacccaacaaccggggtaaattaccagccttttagggtcgtggttctgagcttcgagttactgaacggccccgccactgtgtgcggaccaaagctatcaaccacactcgtcaaagacaagtgtgtgaattttaacttcaatggcctgaccgggactggagtacttacaacgagtaaaaagcagtttttgcccttccaacagttcggtcgggatatatccgacaccactgatgcggtgcgagaccctcagacactggaaattctcgacatcaccccatgcagctttggcggggtttctgtcatcacaccgggaactaacacctcaaatcaggtggccgtgctgtatcaagatgtcaactgtacggaggttcccatggcaattcatgctgagcagcttacccctgcctggcgcgtgtacagtgctggcgccaatgtgttccagacaagagcaggttgcctggtaggggccgaacacgtcaacaatagctatgagtgtgacatcccagtgggcgctggaatttgcgcgtcctaccactctatgtcgagctttaggtccgttaaccagcggtcaataatcgcatacactatgagtttgggcgccgaaaattctgtggcttatagcaacaactccattgccatccccaccaatttcacaatctcagtcactaccgagattctccctgtgagcatgacgaagacatctgttgattgtaccatgtacatatgcggggactccatcgaatgtagtaacctgttactgcaatatggatctttttgcactcagctaaatcgcgcactcacaggtattgccgtggagcaggataaaaacacccaggaggtattcgctcaagtcaagcagatctacaaaactccacccattaaggactttggcgggttcaatttttctcagatcctgccggatccttccaaaccatcaaagagaagtttcatagaagaccttttgtttaacaaggtgaccctggccgatgcaggattcatcaaacaatatggcgactgtctcggtgatattgcggctagggacctgatctgcgcccagaagttcaatgggttaacagtgctgccccctcttttgacggatgagatgattgcacagtacaccagcgccctcctggctggcactatcacatcgggatggacctttggcgccggggcagctctacagatacccttcgccatgcaaatggcgtatcgttttaacggaattggcgtcacacagaatgttctgtacgaaaaccagaaactcatcgccaatcagttcaactccgctattggtaagatccaagactctctgagctcaactgcaagtgcccttgggaaattgcaggacgtggtaaatcagaacgctcaggccctgaataccttagtgaagcaactctcctctaactttggagcaataagctccgtcctgaacgatatcctttcacggctggacaaggtggaggcggaagttcagattgatcgattgatcacgggcagactccagagcctgcaaacatacgtgacccagcagctaattagggccgctgagatccgcgccagtgcaaatctggctgccactaaaatgtctgagtgcgtcctcggtcagtccaagcgggtggacttctgtggcaaagggtatcatctgatgagctttccacaatcggcacctcacggagttgtgttccttcatgtcacctacgtacccgcccaggaaaagaactttacaactgctccagcgatatgccacgagggcaaagcccacttcccgagagaaggggtgtttgtttcaaatggaacccattggttcattacacagaggaacttttatgagcctcagatcatcacgaccgataatactttcgtgtctggcagttgtgacgtcgtgattggtatcgtaaacaatacagtgtacgatcccttgcaaccagagctggactccttcaaggaagagttagataaatattttaagaaccacaccagccccgacgtcgatctcggggacatttctggaataaatgcaagcgttgtgaacatccagaaggaaattgatcgcctgaatgaggtggctaaaaaccttaatgaatccctgatcgacctacaggagctcggcaagtacgagcagtatattaaatggccttggtacatctggctgggtttcatagccggcttgatcgccattatcatggtcactattatgctgtgctgtatgacatcatgctgtagttgcttaaaggggtgttgcagctgtggatcttgctgcaaatttgacgaagatgactccgagccagtgctcaagggcgttaagctgcattacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12538 - RNA, 4076 nt, synthetic construct
  misc_feature 1..4076: note = SARS-CoV-2/pangolin/Guangxi/P5E/2017__EPI_ISL_410541 spike protein mRNA human (1-1267)
  source 1..4076: mol_type = other RNA
aggagagtcccgcagtcggcgtccagcggctctgcttgttcgtgtgtgtgtcgttgcaggccttattcaagcttaccatgttcgtgtttctgttcgtcctcccccttgttagctcccagtgcgtgaacctgaccacaagaactggcatccctccagggtacacaaattcttcaaccaggggagtatattacccggacaaggtgtttcggagtagcattttgcacttaacacaagatctgttcctaccctttttctccaacgtcacttggtttaataccataacatatcagggtggctctaaaaagttcgacaaccctgtgctcccatttaatgatggggtttacttcgcctcgaccgagaaatcaaacatcattcgcggatggatctttggcactacactggacgctcgaacccagagccttctgattgtgaataacgcaacgaatgtcgtgatcaaggtatgtgagttccagttttgcactgatcccttcttgggtgtttattaccataacaataacaaaacctgggtggaaaatgagttccgtgtctatagttccgccaacaattgtacatttgaatacatatctcaacctttcctcatggacctggaagggaagcagggaaactttaagaacctgagagagttcgtgtttaaaaatgtggatggctacttcaagatctatagcaaacacactccaattgacctcgtcagggatttaccccggggctttgcggctctggagcctcttgttgacttgccaatcgggattaacatcacccgcttccagacactgctagccctccatagatcctacctgaccccgggaaaacttgaatcaggttggacgactggcgcagccgcttattacgtggggtatctgcagcaaaggacatttttgctcagttacaatcagaacggaaccataactgatgcagtagactgcagcctggatcccttatctgagacaaagtgtaccctgaagtccctcacggtggaaaagggcatttatcagacctcaaatttccgggtccagcctacaatcagcattgtgcgctttccaaacatcactaatctttgccccttcggtgaggtttttaacgccagtaaattcgcttctgtgtacgcctggaatcgaaagagaatctccaactgtgtcgcggactacagcgtgctgtataattcgacctctttctccacatttaaatgctacggggtatcacctactaagttgaacgacctatgtttcaccaatgtttatgcagatagttttgtggtcaaaggagacgaggtgaggcaaattgccccaggccagacaggcgtcatagctgattacaactataagctgcccgacgatttcaccgggtgcgtgatcgcctggaatagcgttaaacaggacgcactcactggagataactacggttatctgtaccggctttttcgtaagtccaagctgaaaccgttcgaacgcgacatttctacggagatctaccaagctggcagcacaccttgtaacggacaggtggggttgaattgctattaccccctcgaaagatatggctttcacccaaccactggtgtaaactaccagcctttcagggtcgtggttctgtcatttgagttactgaatgggcccgccaccgtgtgcggcccaaagctaagtacaaccctcgtcaaagataagtgtgtgaacttcaattttaacggactgactggcacaggggtacttacgacctccaaaaagcagttcttgccctttcaacagttcggacgggacataagcgatactacagacgcggtgcgagaccctcagaccctggaaattctcgatatcacaccatgctctttcggtggcgtttcagtcatcactccggggaccaatacgagtaaccaggtggccgtgctgtatcaagacgtcaattgtaccgaggttcccatggcaattcatgctgagcagcttacgcctgcctggcgcgtgtacagcgctggagccaacgtgtttcagactagagcaggctgcctggtaggtgccgaacacgtcaataactcctatgagtgtgatatcccagtgggggctggcatttgcgcgtcttaccactcgatgagctccttcaggtcagttaatcagcggagtataatcgcatacaccatgtctttgggagccgaaaacagcgtggcttattccaataactcaattgccatccccacaaactttactatcagcgtcaccacggagattctccctgtgtctatgacaaagacctccgttgactgtactatgtacatatgcggcgatagtatcgaatgtagcaatctgttactgcaatatgggtctttctgcacacagctaaaccgcgcactcaccggaattgccgtggagcaggacaaaaatactcaggaggtatttgctcaagtcaagcagatctacaaaaccccacccattaaggatttcggtggctttaacttctcccagatcctgccggacccttcaaaaccaagtaagaggagctttatagaagatcttttgttcaataaggtgacactggccgacgcagggtttatcaaacaatatggagattgtctcggcgacattgcggctagagatctgatctgcgcccagaagttcaacggtttaacggtgctgccccctcttttgaccgacgagatgattgcacagtacacttcggccctcctggctgggacaatcacctccggctggacattcggagccggcgcagctctacagataccctttgccatgcaaatggcgtatcgtttcaatgggattggagtcactcagaacgttctgtacgaaaatcagaaactcatcgccaaccagtttaattctgctattggcaagatccaagacagcctgtcaagtaccgcatccgcccttggtaaattgcaggatgtggtaaaccagaatgctcaggccctgaacacgttagtgaagcaactctctagcaatttcggggcaatatcctcagtcctgaacgacatccttagccggctggataaggtggaggcggaagttcagattgaccgattgatcacaggaagactccagagtctgcaaacctacgtgactcagcagctaattagggccgctgagatccgcgcctctgcaaacctggctgccaccaaaatgtccgagtgcgtcctcggccagagcaagcgggtggatttttgtggtaaaggctatcatctgatgtcgttcccacaatcagcacctcacggggttgtgtttcttcatgtcacatacgtacccgcccaggaaaagaatttcactaccgctccagcgatatgccacgagggaaaagcccactttccgagagaaggcgtgttcgtttctaacgggacacattggtttattacgcagaggaatttctatgagcctcagatcatcaccactgacaacacatttgtgagtggatcctgtgatgtcgtgattggcatcgtaaataacaccgtgtacgaccccttgcaaccagagctggatagcttcaaggaagagttagacaaatatttcaagaatcacacttctcccgatgtcgacctcggtgatattagcgggataaacgcatccgttgtgaatatccagaaggaaattgaccgcctgaacgaggtggctaaaaatcttaacgaatcactgatcgacctacaggagctcggaaagtacgagcagtatattaaatggccttggtacatctggctgggctttatagccggtttgatcgccattatcatggtcacaattatgctgtgctgtatgaccagttgctgtagctgcttaaagggctgttgctcttgtgggtcctgctgcaaattcgatgaagacgattcagagccagtgctcaagggagttaagctgcattacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12539 - RNA, 4070 nt, synthetic construct
  misc_feature 1..4070: note = SARS-CoV-2/pangolin/Guangxi/P1E/2017__EPI_ISL_410539 spike protein mRNA human (1-1265)
  source 1..4070: mol_type = other RNA
aggagagtcccgcagtcggcgtccagcggctctgcttgttcgtgtgtgtgtcgttgcaggccttattcaagcttaccatgttcgtgtttctgttcgtcctcccccttgttagctcccagtgcgtgaacctgaccacaagaactggcatccaacctgggtacaccaattcttcaacgaggggagtatattacccagacaaggtgtttcggagtagcattttgcacttaacacaggatctgttcctaccgtttttctccaacgtcacttggtttaataccataaactatcagggtggcttcaagaagtttgacaatcccgtgctccctttcaacgatggggtttactttgcctctacagagaaatcgaatatcattcgcggatggatcttcggcaccactctggacgctcgaacacagtcacttctgattgtgaacaatgcaaccaacgtcgtgatcaaggtatgtgaatttcaattctgcacggatccattcttgggtgtttattaccataataacaataaaacttgggtggagaacgaatttcgtgtctatagcagtgccaataactgtaccttcgagtacatatcccagccctttctcatggacctggaagggaagcagggaaacttcaagaatctgagagagtttgtgttcaaaaacgtggatggctactttaagatctattctaaacacacacctattgacctcgtcagggatttaccacggggcttcgcggctctggagccccttgttgacttgcctatcgggattaatatcactcgctttcagaccctgctagccctccatagaagctacctgacaccaggaaaacttgaatccggttggaccacgggcgcagccgcttattacgtggggtatctgcaacagaggactttcttgctctcatacaaccagaatggaacaataaccgatgcagtagactgcagtctggatccgttaagcgagactaagtgtacactgaagtctctcaccgtggaaaagggcatttatcagacgtccaactttcgggtccaacccaccatctcaattgtgcgcttccctaatatcacaaacctttgcccatttggtgaggttttcaatgccagcaaattcgctagtgtgtacgcctggaaccgaaagagaatctctaattgtgtcgcggactactccgtgctgtataacagcacttcgttttctaccttcaaatgctacggggtatcccccacaaagttgaatgacctatgttttactaacgtttatgcagattcattcgtggtcaaaggagacgaggtgaggcagattgcccctggccagaccggcgtcatagctgattacaattataagctgccagacgattttacagggtgcgtgatcgcctggaacagtgttaaacaagacgcactcaccggaggtaactacctgtatcggcttttccgtaagagcaagctgaaaccctttgaacgcgatatttccactgagatctaccaggctggctctacgccgtgtaatggacaggtggggttgaactgctactatcctctcgaaagatacggcttccaccccacaaccggtgtaaattatcagccatttagggtcgtggttctgagcttcgagttactgaacgggcctgccactgtgtgcggccccaagctatcaaccacactcgtcaaagacaagtgtgtgaattttaacttcaatggactgaccggcactggggtacttacaacgagtaaaaagcaatttttgccattccagcagttcggacgggatatatccgacaccactgatgcggtgcgagacccccagacactggaaattctcgacatcaccccttgcagctttggtggcgtttctgtcatcacaccagggactaacacctcaaatcaagtggccgtgctgtaccaggatgtcaactgtacggaggttccgatggcaattcatgctgagcagcttacccccgcctggcgcgtgtatagtgctggagccaatgtgttccagacaagagcaggctgcctggtaggtgccgaacacgtcaacaatagctacgagtgtgacatccctgtgggggctggcatttgcgcgtcctatcactctatgtcgagcttgaggtccgttaaccaacggtcaataatcgcatacactatgagtctcggagccgaaaattctgtggcttacagcaacaactccattgccatcccaaccaattttacaatctcagtcactaccgagattctgcccgtgagcatgacgaagacatctgttgattgtaccatgtatatatgcggcgactccatcgaatgtagtaacttactgctacagtacgggagcttctgcactcagctcaatcgcgcactgacaggaattgccgtggagcaggataaaaacacccaagaggtatttgctcaggtcaagcagatctataaaactcctccaattaaggacttcggtggctttaatttctctcaaatccttcccgatccgtccaaaccttcaaagagaagttttatagaagacttgctgttcaacaaggtgaccctcgccgatgcagggtttatcaaacagtacggagactgtctgggcgatattgcggctagggacttaatctgcgcccagaagttcaatggtctgacagtgcttccacccttgctcacggatgagatgattgcacagtataccagcgccctgctagctgggactatcacatcgggctggaccttcggagccggcgcagctctgcaaataccttttgccatgcagatggcgtaccgtttcaacgggattggagtcacacagaatgttctctatgaaaaccagaaactgatcgccaatcaatttaactccgctattggcaagatccaggactctcttagctcaactgcaagtgccttgggtaaactgcaggacgtggtaaatcagaacgctcaagccttaaataccctcgtgaagcagctgtcctctaacttcggggcaataagctccgtccttaacgatatcctgtcacggttggacaaggtggaggcggaagttcagattgatcgactcatcacgggaagactgcaaagcctacagacatacgtgacccagcagctgattagggccgctgagatccgcgccagtgcaaatctcgctgccactaaaatgtctgagtgcgtcctgggccaatccaagcgggtggacttttgtggtaaaggctaccatcttatgagcttcccccagtcggcaccacacggggttgtgtttttgcatgtcacctatgtacctgcccaggaaaagaacttcacaactgctcccgcgatatgccacgagggaaaagcccactttccaagagaaggcgtgttcgtttcaaatgggacccattggtttattacacagaggaacttctacgagccgcaaatcatcacgaccgataatacttttgtgtctggaagttgtgacgtcgtgattggcatcgtaaacaatacagtgtatgatcctctgcagcccgagttagactccttcaaggaggaactcgataaatacttcaagaaccacaccagcccagacgtcgatctgggtgacatttctgggataaatgcaagcgttgtgaacatccagaaggaaattgatcgccttaatgaggtggctaaaaacctgaatgaatccctaatcgacctccaggagctgggaaagtatgagcaatacattaaatggccctggtatatctggttgggctttatagccggtctgatcgccattatcatggtcactattatgttatgctgtatgacatcatgctgtagttgcctcaagggctgttgcagctgtgggtcttgctgcaaattcgacgaagatgactccgagcctgtgctgaagggagttaaacttcattacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12540 - RNA, 4094 nt, synthetic construct
  misc_feature 1..4094: note = SARS-CoV-2/Wuhan/WIV05/2019__EPI_ISL_402128 spike protein mRNA gc mod (1-1273)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12541 - RNA, 4094 nt, synthetic construct; identical to SEQ ID NO: 151
  misc_feature 1..4094: note = SARS-CoV-2/Wuhan/WIV05/2019__EPI_ISL_402128 spike protein mRNA gc mod (1-1273)(K986P_V987P) R10162
  source 1..4094: mol_type = other RNA

SEQ ID NO: 12542 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_T887WN_A1020W)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12543 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_P1069F)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12544 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_ H1048Q_H1064N_ H1083N_H1101N)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12545 - RNA, 4094 nt, synthetic construct
  misc_feature 1..4094: note = SARS-CoV-2/Wuhan/WIV05/2019__EPI_ISL_402128 spike protein mRNA gc mod (1-1273)(I712C_T1077C)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12546 - RNA, 4094 nt, synthetic construct
  misc_feature 1..4094: note = SARS-CoV-2/Wuhan/WIV05/2019__EPI_ISL_402128 spike protein mRNA gc mod (1-1273)(I714C_Y1110C)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12547 - RNA, 4094 nt, synthetic construct
  misc_feature 1..4094: note = SARS-CoV-2/Wuhan/WIV05/2019__EPI_ISL_402128 spike protein mRNA gc mod (1-1273)(P715C_P1069C)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12548 - RNA, 4094 nt, synthetic construct
  misc_feature 1..4094: note = SARS-CoV-2/Wuhan/WIV05/2019__EPI_ISL_402128 spike protein mRNA gc mod (1-1273)(G889C_L1034C)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12549 - RNA, 4094 nt, synthetic construct
  misc_feature 1..4094: note = SARS-CoV-2/Wuhan/WIV05/2019__EPI_ISL_402128 spike protein mRNA gc mod (1-1273)(I909C_Y1047C)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12550 - RNA, 4094 nt, synthetic construct
  misc_feature 1..4094: note = SARS-CoV-2/Wuhan/WIV05/2019__EPI_ISL_402128 spike protein mRNA gc mod (1-1273)(Q965C_S1003C)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12551 - RNA, 4094 nt, synthetic construct
  misc_feature 1..4094: note = SARS-CoV-2/Wuhan/WIV05/2019__EPI_ISL_402128 spike protein mRNA gc mod (1-1273)(F970C_G999C)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12552 - RNA, 4094 nt, synthetic construct
  misc_feature 1..4094: note = SARS-CoV-2/Wuhan/WIV05/2019__EPI_ISL_402128 spike protein mRNA gc mod (1-1273)(A972C_R995C)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12553 - RNA, 4094 nt, synthetic construct
  misc_feature 1..4094: note = SARS-CoV-2/Wuhan/WIV05/2019__EPI_ISL_402128 spike protein mRNA gc mod (1-1273)(A890C_V1040C)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12554 - RNA, 4094 nt, synthetic construct
  misc_feature 1..4094: note = SARS-CoV-2/Wuhan/WIV05/2019__EPI_ISL_402128 spike protein mRNA gc mod (1-1273)(T874C_S1055C)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12555 - RNA, 2318 nt, synthetic construct; identical to SEQ ID NO: 154
  misc_feature 1..2318: note = SARS-CoV-2/Wuhan/WIV05/2019__EPI_ISL_402128 spike protein mRNA gc mod (1-681)
  source 1..2318: mol_type = other RNA

SEQ ID NO: 12556 - RNA, 4388 nt, synthetic construct
  misc_feature 1..4388: note = SARS-CoV-2/Wuhan/WIV05/2019__EPI_ISL_402128 spike protein mRNA gc mod (1-1211) LumSynth construct
  source 1..4388: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12557 - RNA, 4388 nt, synthetic construct
  misc_feature 1..4388: note = SARS-CoV-2/Wuhan/WIV05/2019__EPI_ISL_402128 spike protein mRNA gc mod (1-1211)(K986P_V987P) LumSynth construct
  source 1..4388: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12558 - RNA, 4388 nt, synthetic construct
  misc_feature 1..4388: note = SARS-CoV-2/Wuhan/WIV05/2019__EPI_ISL_402128 spike protein mRNA gc mod (1-1211)(K986P_V987P_T887WN_A1020W) LumSynth construct
  source 1..4388: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12559 - RNA, 4388 nt, synthetic construct
  misc_feature 1..4388: note = SARS-CoV-2/Wuhan/WIV05/2019__EPI_ISL_402128 spike protein mRNA gc mod (1-1211)(K986P_V987P_P1069F) LumSynth construct
  source 1..4388: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12560 - RNA, 4388 nt, synthetic construct
  misc_feature 1..4388: note = SARS-CoV-2/Wuhan/WIV05/2019__EPI_ISL_402128 spike protein mRNA gc mod (1-1211)(K986P_V987P_ H1048Q_H1064N_ H1083N_H1101N) LumSynth construct
  source 1..4388: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12561 - RNA, 4388 nt, synthetic construct
  misc_feature 1..4388: note = SARS-CoV-2/Wuhan/WIV05/2019__EPI_ISL_402128 spike protein mRNA gc mod (1-1211)(I712C_T1077C) LumSynth construct
  source 1..4388: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12562 - RNA, 4388 nt, synthetic construct
  misc_feature 1..4388: note = SARS-CoV-2/Wuhan/WIV05/2019__EPI_ISL_402128 spike protein mRNA gc mod (1-1211)(I714C_Y1110C) LumSynth construct
  source 1..4388: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12563 - RNA, 4388 nt, synthetic construct
  misc_feature 1..4388: note = SARS-CoV-2/Wuhan/WIV05/2019__EPI_ISL_402128 spike protein mRNA gc mod (1-1211)(P715C_P1069C) LumSynth construct
  source 1..4388: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12564 - RNA, 4388 nt, synthetic construct
  misc_feature 1..4388: note = SARS-CoV-2/Wuhan/WIV05/2019__EPI_ISL_402128 spike protein mRNA gc mod (1-1211)(G889C_L1034C) LumSynth construct
  source 1..4388: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12565 - RNA, 4388 nt, synthetic construct
  misc_feature 1..4388: note = SARS-CoV-2/Wuhan/WIV05/2019__EPI_ISL_402128 spike protein mRNA gc mod (1-1211)(I909C_Y1047C) LumSynth construct
  source 1..4388: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12566 - RNA, 4388 nt, synthetic construct
  misc_feature 1..4388: note = SARS-CoV-2/Wuhan/WIV05/2019__EPI_ISL_402128 spike protein mRNA gc mod (1-1211)(Q965C_S1003C) LumSynth construct
  source 1..4388: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12567 - RNA, 4388 nt, synthetic construct
  misc_feature 1..4388: note = SARS-CoV-2/Wuhan/WIV05/2019__EPI_ISL_402128 spike protein mRNA gc mod (1-1211)(F970C_G999C) LumSynth construct
  source 1..4388: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12568 - RNA, 4388 nt, synthetic construct
  misc_feature 1..4388: note = SARS-CoV-2/Wuhan/WIV05/2019__EPI_ISL_402128 spike protein mRNA gc mod (1-1211)(A972C_R995C) LumSynth construct
  source 1..4388: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12569 - RNA, 4388 nt, synthetic construct
  misc_feature 1..4388: note = SARS-CoV-2/Wuhan/WIV05/2019__EPI_ISL_402128 spike protein mRNA gc mod (1-1211)(A890C_V1040C) LumSynth construct
  source 1..4388: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12570 - RNA, 4388 nt, synthetic construct
  misc_feature 1..4388: note = SARS-CoV-2/Wuhan/WIV05/2019__EPI_ISL_402128 spike protein mRNA gc mod (1-1211)(T874C_S1055C) LumSynth construct
  source 1..4388: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12571 - RNA, 4412 nt, synthetic construct
  misc_feature 1..4412: note = SARS-CoV-2/Wuhan/WIV05/2019__EPI_ISL_402128 spike protein mRNA gc mod (1-1211) Ferritin construct
  source 1..4412: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12572 - RNA, 4412 nt, synthetic construct
  misc_feature 1..4412: note = SARS-CoV-2/Wuhan/WIV05/2019__EPI_ISL_402128 spike protein mRNA gc mod (1-1211)(K986P_V987P) Ferritin construct
  source 1..4412: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12573 - RNA, 4412 nt, synthetic construct
  misc_feature 1..4412: note = SARS-CoV-2/Wuhan/WIV05/2019__EPI_ISL_402128 spike protein mRNA gc mod (1-1211)(K986P_V987P_T887WN_A1020W) Ferritin construct
  source 1..4412: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12574 - RNA, 4412 nt, synthetic construct
  misc_feature 1..4412: note = SARS-CoV-2/Wuhan/WIV05/2019__EPI_ISL_402128 spike protein mRNA gc mod (1-1211)(K986P_V987P_P1069F) Ferritin construct
  source 1..4412: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12575 - RNA, 4412 nt, synthetic construct
  misc_feature 1..4412: note = SARS-CoV-2/Wuhan/WIV05/2019__EPI_ISL_402128 spike protein mRNA gc mod (1-1211)(K986P_V987P_ H1048Q_H1064N_ H1083N_H1101N) Ferritin construct
  source 1..4412: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12576 - RNA, 4412 nt, synthetic construct
  misc_feature 1..4412: note = SARS-CoV-2/Wuhan/WIV05/2019__EPI_ISL_402128 spike protein mRNA gc mod (1-1211)(I712C_T1077C) Ferritin construct
  source 1..4412: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12577 - RNA, 4412 nt, synthetic construct
  misc_feature 1..4412: note = SARS-CoV-2/Wuhan/WIV05/2019__EPI_ISL_402128 spike protein mRNA gc mod (1-1211)(I714C_Y1110C) Ferritin construct
  source 1..4412: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12578 - RNA, 4412 nt, synthetic construct
  misc_feature 1..4412: note = SARS-CoV-2/Wuhan/WIV05/2019__EPI_ISL_402128 spike protein mRNA gc mod (1-1211)(P715C_P1069C) Ferritin construct
  source 1..4412: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12579 - RNA, 4412 nt, synthetic construct
  misc_feature 1..4412: note = SARS-CoV-2/Wuhan/WIV05/2019__EPI_ISL_402128 spike protein mRNA gc mod (1-1211)(G889C_L1034C) Ferritin construct
  source 1..4412: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12580 - RNA, 4412 nt, synthetic construct
  misc_feature 1..4412: note = SARS-CoV-2/Wuhan/WIV05/2019__EPI_ISL_402128 spike protein mRNA gc mod (1-1211)(I909C_Y1047C) Ferritin construct
  source 1..4412: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12581 - RNA, 4412 nt, synthetic construct
  misc_feature 1..4412: note = SARS-CoV-2/Wuhan/WIV05/2019__EPI_ISL_402128 spike protein mRNA gc mod (1-1211)(Q965C_S1003C) Ferritin construct
  source 1..4412: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12582 - RNA, 4412 nt, synthetic construct
  misc_feature 1..4412: note = SARS-CoV-2/Wuhan/WIV05/2019__EPI_ISL_402128 spike protein mRNA gc mod (1-1211)(F970C_G999C) Ferritin construct
  source 1..4412: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12583 - RNA, 4412 nt, synthetic construct
  misc_feature 1..4412: note = SARS-CoV-2/Wuhan/WIV05/2019__EPI_ISL_402128 spike protein mRNA gc mod (1-1211)(A972C_R995C) Ferritin construct
  source 1..4412: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12584 - RNA, 4412 nt, synthetic construct
  misc_feature 1..4412: note = SARS-CoV-2/Wuhan/WIV05/2019__EPI_ISL_402128 spike protein mRNA gc mod (1-1211)(A890C_V1040C) Ferritin construct
  source 1..4412: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12585 - RNA, 4412 nt, synthetic construct
  misc_feature 1..4412: note = SARS-CoV-2/Wuhan/WIV05/2019__EPI_ISL_402128 spike protein mRNA gc mod (1-1211)(T874C_S1055C) Ferritin construct
  source 1..4412: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12586 - RNA, 3998 nt, synthetic construct
  misc_feature 1..3998: note = SARS-CoV-2/Wuhan/WIV05/2019__EPI_ISL_402128 spike protein mRNA gc mod (1-1211) Foldon construct
  source 1..3998: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12587 - RNA, 3998 nt, synthetic construct
  misc_feature 1..3998: note = SARS-CoV-2/Wuhan/WIV05/2019__EPI_ISL_402128 spike protein mRNA gc mod (1-1211)(K986P_V987P) Foldon construct
  source 1..3998: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12588 - RNA, 3998 nt, synthetic construct
  misc_feature 1..3998: note = SARS-CoV-2/Wuhan/WIV05/2019__EPI_ISL_402128 spike protein mRNA gc mod (1-1211)(K986P_V987P_T887WN_A1020W) Foldon construct
  source 1..3998: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12589 - RNA, 3998 nt, synthetic construct
  misc_feature 1..3998: note = SARS-CoV-2/Wuhan/WIV05/2019__EPI_ISL_402128 spike protein mRNA gc mod (1-1211)(K986P_V987P_P1069F) Foldon construct
  source 1..3998: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12590 - RNA, 3998 nt, synthetic construct
  misc_feature 1..3998: note = SARS-CoV-2/Wuhan/WIV05/2019__EPI_ISL_402128 spike protein mRNA gc mod (1-1211)(K986P_V987P_ H1048Q_H1064N_ H1083N_H1101N) Foldon construct
  source 1..3998: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12591 - RNA, 3998 nt, synthetic construct
  misc_feature 1..3998: note = SARS-CoV-2/Wuhan/WIV05/2019__EPI_ISL_402128 spike protein mRNA gc mod (1-1211)(I712C_T1077C) Foldon construct
  source 1..3998: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12592 - RNA, 3998 nt, synthetic construct
  misc_feature 1..3998: note = SARS-CoV-2/Wuhan/WIV05/2019__EPI_ISL_402128 spike protein mRNA gc mod (1-1211)(I714C_Y1110C) Foldon construct
  source 1..3998: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12593 - RNA, 3998 nt, synthetic construct
  misc_feature 1..3998: note = SARS-CoV-2/Wuhan/WIV05/2019__EPI_ISL_402128 spike protein mRNA gc mod (1-1211)(P715C_P1069C) Foldon construct
  source 1..3998: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12594 - RNA, 3998 nt, synthetic construct
  misc_feature 1..3998: note = SARS-CoV-2/Wuhan/WIV05/2019__EPI_ISL_402128 spike protein mRNA gc mod (1-1211)(G889C_L1034C) Foldon construct
  source 1..3998: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12595 - RNA, 3998 nt, synthetic construct
  misc_feature 1..3998: note = SARS-CoV-2/Wuhan/WIV05/2019__EPI_ISL_402128 spike protein mRNA gc mod (1-1211)(I909C_Y1047C) Foldon construct
  source 1..3998: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12596 - RNA, 3998 nt, synthetic construct
  misc_feature 1..3998: note = SARS-CoV-2/Wuhan/WIV05/2019__EPI_ISL_402128 spike protein mRNA gc mod (1-1211)(Q965C_S1003C) Foldon construct
  source 1..3998: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12597 - RNA, 3998 nt, synthetic construct
  misc_feature 1..3998: note = SARS-CoV-2/Wuhan/WIV05/2019__EPI_ISL_402128 spike protein mRNA gc mod (1-1211)(F970C_G999C) Foldon construct
  source 1..3998: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12598 - RNA, 3998 nt, synthetic construct
  misc_feature 1..3998: note = SARS-CoV-2/Wuhan/WIV05/2019__EPI_ISL_402128 spike protein mRNA gc mod (1-1211)(A972C_R995C) Foldon construct
  source 1..3998: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12599 - RNA, 3998 nt, synthetic construct
  misc_feature 1..3998: note = SARS-CoV-2/Wuhan/WIV05/2019__EPI_ISL_402128 spike protein mRNA gc mod (1-1211)(A890C_V1040C) Foldon construct
  source 1..3998: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12600 - RNA, 3998 nt, synthetic construct
  misc_feature 1..3998: note = SARS-CoV-2/Wuhan/WIV05/2019__EPI_ISL_402128 spike protein mRNA gc mod (1-1211)(T874C_S1055C) Foldon construct
  source 1..3998: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12601 - RNA, 4370 nt, synthetic construct
  misc_feature 1..4370: note = SARS-CoV-2/Wuhan/WIV05/2019__EPI_ISL_402128 spike protein mRNA gc mod (1-1211) WhcAg construct
  source 1..4370: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12602 - RNA, 4370 nt, synthetic construct
  misc_feature 1..4370: note = SARS-CoV-2/Wuhan/WIV05/2019__EPI_ISL_402128 spike protein mRNA gc mod (1-1211)(K986P_V987P) WhcAg construct
  source 1..4370: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12603 - RNA, 4370 nt, synthetic construct
  misc_feature 1..4370: note = SARS-CoV-2/Wuhan/WIV05/2019__EPI_ISL_402128 spike protein mRNA gc mod (1-1211)(K986P_V987P_T887WN_A1020W) WhcAg construct
  source 1..4370: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12604 - RNA, 4370 nt, synthetic construct
  misc_feature 1..4370: note = SARS-CoV-2/Wuhan/WIV05/2019__EPI_ISL_402128 spike protein mRNA gc mod (1-1211)(K986P_V987P_P1069F) WhcAg construct
  source 1..4370: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12605 - RNA, 4370 nt, synthetic construct
  misc_feature 1..4370: note = SARS-CoV-2/Wuhan/WIV05/2019__EPI_ISL_402128 spike protein mRNA gc mod (1-1211)(K986P_V987P_ H1048Q_H1064N_ H1083N_H1101N) WhcAg construct
  source 1..4370: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12606 - RNA, 4370 nt, synthetic construct
  misc_feature 1..4370: note = SARS-CoV-2/Wuhan/WIV05/2019__EPI_ISL_402128 spike protein mRNA gc mod (1-1211)(I712C_T1077C) WhcAg construct
  source 1..4370: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12607 - RNA, 4370 nt, synthetic construct
  misc_feature 1..4370: note = SARS-CoV-2/Wuhan/WIV05/2019__EPI_ISL_402128 spike protein mRNA gc mod (1-1211)(I714C_Y1110C) WhcAg construct
  source 1..4370: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12608 - RNA, 4370 nt, synthetic construct
  misc_feature 1..4370: note = SARS-CoV-2/Wuhan/WIV05/2019__EPI_ISL_402128 spike protein mRNA gc mod (1-1211)(P715C_P1069C) WhcAg construct
  source 1..4370: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12609 - RNA, 4370 nt, synthetic construct
  misc_feature 1..4370: note = SARS-CoV-2/Wuhan/WIV05/2019__EPI_ISL_402128 spike protein mRNA gc mod (1-1211)(G889C_L1034C) WhcAg construct
  source 1..4370: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12610 - RNA, 4370 nt, synthetic construct
  misc_feature 1..4370: note = SARS-CoV-2/Wuhan/WIV05/2019__EPI_ISL_402128 spike protein mRNA gc mod (1-1211)(I909C_Y1047C) WhcAg construct
  source 1..4370: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12611 - RNA, 4370 nt, synthetic construct
  misc_feature 1..4370: note = SARS-CoV-2/Wuhan/WIV05/2019__EPI_ISL_402128 spike protein mRNA gc mod (1-1211)(Q965C_S1003C) WhcAg construct
  source 1..4370: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12612 - RNA, 4370 nt, synthetic construct
  misc_feature 1..4370: note = SARS-CoV-2/Wuhan/WIV05/2019__EPI_ISL_402128 spike protein mRNA gc mod (1-1211)(F970C_G999C) WhcAg construct
  source 1..4370: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12613 - RNA, 4370 nt, synthetic construct
  misc_feature 1..4370: note = SARS-CoV-2/Wuhan/WIV05/2019__EPI_ISL_402128 spike protein mRNA gc mod (1-1211)(A972C_R995C) WhcAg construct
  source 1..4370: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12614 - RNA, 4370 nt, synthetic construct
  misc_feature 1..4370: note = SARS-CoV-2/Wuhan/WIV05/2019__EPI_ISL_402128 spike protein mRNA gc mod (1-1211)(A890C_V1040C) WhcAg construct
  source 1..4370: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12615 - RNA, 4370 nt, synthetic construct
  misc_feature 1..4370: note = SARS-CoV-2/Wuhan/WIV05/2019__EPI_ISL_402128 spike protein mRNA gc mod (1-1211)(T874C_S1055C) WhcAg construct
  source 1..4370: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12616 - RNA, 4196 nt, synthetic construct
  misc_feature 1..4196: note = SARS-CoV-2/Wuhan/WIV05/2019__EPI_ISL_402128 spike protein mRNA gc mod (1-1147) LumSynth construct
  source 1..4196: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12617 - RNA, 4196 nt, synthetic construct
  misc_feature 1..4196: note = SARS-CoV-2/Wuhan/WIV05/2019__EPI_ISL_402128 spike protein mRNA gc mod (1-1147)(K986P_V987P) LumSynth construct
  source 1..4196: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12618 - RNA, 4196 nt, synthetic construct
  misc_feature 1..4196: note = SARS-CoV-2/Wuhan/WIV05/2019__EPI_ISL_402128 spike protein mRNA gc mod (1-1147)(K986P_V987P_T887WN_A1020W) LumSynth construct
  source 1..4196: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12619 - RNA, 4196 nt, synthetic construct
  misc_feature 1..4196: note = SARS-CoV-2/Wuhan/WIV05/2019__EPI_ISL_402128 spike protein mRNA gc mod (1-1147)(K986P_V987P_P1069F) LumSynth construct
  source 1..4196: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12620 - RNA, 4196 nt, synthetic construct
  misc_feature 1..4196: note = SARS-CoV-2/Wuhan/WIV05/2019__EPI_ISL_402128 spike protein mRNA gc mod (1-1147)(K986P_V987P_ H1048Q_H1064N_ H1083N_H1101N) LumSynth construct
  source 1..4196: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12621 - RNA, 4196 nt, synthetic construct
  misc_feature 1..4196: note = SARS-CoV-2/Wuhan/WIV05/2019__EPI_ISL_402128 spike protein mRNA gc mod (1-1147)(I712C_T1077C) LumSynth construct
  source 1..4196: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12622 - RNA, 4196 nt, synthetic construct
  misc_feature 1..4196: note = SARS-CoV-2/Wuhan/WIV05/2019__EPI_ISL_402128 spike protein mRNA gc mod (1-1147)(I714C_Y1110C) LumSynth construct
  source 1..4196: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12623 - RNA, 4196 nt, synthetic construct
  misc_feature 1..4196: note = SARS-CoV-2/Wuhan/WIV05/2019__EPI_ISL_402128 spike protein mRNA gc mod (1-1147)(P715C_P1069C) LumSynth construct
  source 1..4196: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12624 - RNA, 4196 nt, synthetic construct
  misc_feature 1..4196: note = SARS-CoV-2/Wuhan/WIV05/2019__EPI_ISL_402128 spike protein mRNA gc mod (1-1147)(G889C_L1034C) LumSynth construct
  source 1..4196: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12625 - RNA, 4196 nt, synthetic construct
  misc_feature 1..4196: note = SARS-CoV-2/Wuhan/WIV05/2019__EPI_ISL_402128 spike protein mRNA gc mod (1-1147)(I909C_Y1047C) LumSynth construct
  source 1..4196: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12626 - RNA, 4196 nt, synthetic construct
  misc_feature 1..4196: note = SARS-CoV-2/Wuhan/WIV05/2019__EPI_ISL_402128 spike protein mRNA gc mod (1-1147)(Q965C_S1003C) LumSynth construct
  source 1..4196: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12627 - RNA, 4196 nt, synthetic construct
  misc_feature 1..4196: note = SARS-CoV-2/Wuhan/WIV05/2019__EPI_ISL_402128 spike protein mRNA gc mod (1-1147)(F970C_G999C) LumSynth construct
  source 1..4196: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12628 - RNA, 4196 nt, synthetic construct
  misc_feature 1..4196: note = SARS-CoV-2/Wuhan/WIV05/2019__EPI_ISL_402128 spike protein mRNA gc mod (1-1147)(A972C_R995C) LumSynth construct
  source 1..4196: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12629 - RNA, 4196 nt, synthetic construct
  misc_feature 1..4196: note = SARS-CoV-2/Wuhan/WIV05/2019__EPI_ISL_402128 spike protein mRNA gc mod (1-1147)(A890C_V1040C) LumSynth construct
  source 1..4196: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12630 - RNA, 4196 nt, synthetic construct
  misc_feature 1..4196: note = SARS-CoV-2/Wuhan/WIV05/2019__EPI_ISL_402128 spike protein mRNA gc mod (1-1147)(T874C_S1055C) LumSynth construct
  source 1..4196: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12631 - RNA, 4220 nt, synthetic construct
  misc_feature 1..4220: note = SARS-CoV-2/Wuhan/WIV05/2019__EPI_ISL_402128 spike protein mRNA gc mod (1-1147) Ferritin construct
  source 1..4220: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12632 - RNA, 4220 nt, synthetic construct
  misc_feature 1..4220: note = SARS-CoV-2/Wuhan/WIV05/2019__EPI_ISL_402128 spike protein mRNA gc mod (1-1147)(K986P_V987P) Ferritin construct
  source 1..4220: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12633 - RNA, 4220 nt, synthetic construct
  misc_feature 1..4220: note = SARS-CoV-2/Wuhan/WIV05/2019__EPI_ISL_402128 spike protein mRNA gc mod (1-1147)(K986P_V987P_T887WN_A1020W) Ferritin construct
  source 1..4220: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12634 - RNA, 4220 nt, synthetic construct
  misc_feature 1..4220: note = SARS-CoV-2/Wuhan/WIV05/2019__EPI_ISL_402128 spike protein mRNA gc mod (1-1147)(K986P_V987P_P1069F) Ferritin construct
  source 1..4220: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12635 - RNA, 4220 nt, synthetic construct
  misc_feature 1..4220: note = SARS-CoV-2/Wuhan/WIV05/2019__EPI_ISL_402128 spike protein mRNA gc mod (1-1147)(K986P_V987P_ H1048Q_H1064N_ H1083N_H1101N) Ferritin construct
  source 1..4220: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12636 - RNA, 4220 nt, synthetic construct
  misc_feature 1..4220: note = SARS-CoV-2/Wuhan/WIV05/2019__EPI_ISL_402128 spike protein mRNA gc mod (1-1147)(I712C_T1077C) Ferritin construct
  source 1..4220: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12637 - RNA, 4220 nt, synthetic construct
  misc_feature 1..4220: note = SARS-CoV-2/Wuhan/WIV05/2019__EPI_ISL_402128 spike protein mRNA gc mod (1-1147)(I714C_Y1110C) Ferritin construct
  source 1..4220: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12638 - RNA, 4220 nt, synthetic construct
  misc_feature 1..4220: note = SARS-CoV-2/Wuhan/WIV05/2019__EPI_ISL_402128 spike protein mRNA gc mod (1-1147)(P715C_P1069C) Ferritin construct
  source 1..4220: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12639 - RNA, 4220 nt, synthetic construct
  misc_feature 1..4220: note = SARS-CoV-2/Wuhan/WIV05/2019__EPI_ISL_402128 spike protein mRNA gc mod (1-1147)(G889C_L1034C) Ferritin construct
  source 1..4220: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12640 - RNA, 4220 nt, synthetic construct
  misc_feature 1..4220: note = SARS-CoV-2/Wuhan/WIV05/2019__EPI_ISL_402128 spike protein mRNA gc mod (1-1147)(I909C_Y1047C) Ferritin construct
  source 1..4220: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12641 - RNA, 4220 nt, synthetic construct
  misc_feature 1..4220: note = SARS-CoV-2/Wuhan/WIV05/2019__EPI_ISL_402128 spike protein mRNA gc mod (1-1147)(Q965C_S1003C) Ferritin construct
  source 1..4220: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12642 - RNA, 4220 nt, synthetic construct
  misc_feature 1..4220: note = SARS-CoV-2/Wuhan/WIV05/2019__EPI_ISL_402128 spike protein mRNA gc mod (1-1147)(F970C_G999C) Ferritin construct
  source 1..4220: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12643 - RNA, 4220 nt, synthetic construct
  misc_feature 1..4220: note = SARS-CoV-2/Wuhan/WIV05/2019__EPI_ISL_402128 spike protein mRNA gc mod (1-1147)(A972C_R995C) Ferritin construct
  source 1..4220: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12644 - RNA, 4220 nt, synthetic construct
  misc_feature 1..4220: note = SARS-CoV-2/Wuhan/WIV05/2019__EPI_ISL_402128 spike protein mRNA gc mod (1-1147)(A890C_V1040C) Ferritin construct
  source 1..4220: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12645 - RNA, 4220 nt, synthetic construct
  misc_feature 1..4220: note = SARS-CoV-2/Wuhan/WIV05/2019__EPI_ISL_402128 spike protein mRNA gc mod (1-1147)(T874C_S1055C) Ferritin construct
  source 1..4220: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12646 - RNA, 3806 nt, synthetic construct
  misc_feature 1..3806: note = SARS-CoV-2/Wuhan/WIV05/2019__EPI_ISL_402128 spike protein mRNA gc mod (1-1147) Foldon construct
  source 1..3806: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12647 - RNA, 3806 nt, synthetic construct
  misc_feature 1..3806: note = SARS-CoV-2/Wuhan/WIV05/2019__EPI_ISL_402128 spike protein mRNA gc mod (1-1147)(K986P_V987P) Foldon construct
  source 1..3806: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12648 - RNA, 3806 nt, synthetic construct
  misc_feature 1..3806: note = SARS-CoV-2/Wuhan/WIV05/2019__EPI_ISL_402128 spike protein mRNA gc mod (1-1147)(K986P_V987P_T887WN_A1020W) Foldon construct
  source 1..3806: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12649 - RNA, 3806 nt, synthetic construct
  misc_feature 1..3806: note = SARS-CoV-2/Wuhan/WIV05/2019__EPI_ISL_402128 spike protein mRNA gc mod (1-1147)(K986P_V987P_P1069F) Foldon construct
  source 1..3806: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12650 - RNA, 3806 nt, synthetic construct
  misc_feature 1..3806: note = SARS-CoV-2/Wuhan/WIV05/2019__EPI_ISL_402128 spike protein mRNA gc mod (1-1147)(K986P_V987P_ H1048Q_H1064N_ H1083N_H1101N) Foldon construct
  source 1..3806: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12651 - RNA, 3806 nt, synthetic construct
  misc_feature 1..3806: note = SARS-CoV-2/Wuhan/WIV05/2019__EPI_ISL_402128 spike protein mRNA gc mod (1-1147)(I712C_T1077C) Foldon construct
  source 1..3806: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12652 - RNA, 3806 nt, synthetic construct
  misc_feature 1..3806: note = SARS-CoV-2/Wuhan/WIV05/2019__EPI_ISL_402128 spike protein mRNA gc mod (1-1147)(I714C_Y1110C) Foldon construct
  source 1..3806: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12653 - RNA, 3806 nt, synthetic construct
  misc_feature 1..3806: note = SARS-CoV-2/Wuhan/WIV05/2019__EPI_ISL_402128 spike protein mRNA gc mod (1-1147)(P715C_P1069C) Foldon construct
  source 1..3806: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12654 - RNA, 3806 nt, synthetic construct
  misc_feature 1..3806: note = SARS-CoV-2/Wuhan/WIV05/2019__EPI_ISL_402128 spike protein mRNA gc mod (1-1147)(G889C_L1034C) Foldon construct
  source 1..3806: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12655 - RNA, 3806 nt, synthetic construct
  misc_feature 1..3806: note = SARS-CoV-2/Wuhan/WIV05/2019__EPI_ISL_402128 spike protein mRNA gc mod (1-1147)(I909C_Y1047C) Foldon construct
  source 1..3806: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12656 - RNA, 3806 nt, synthetic construct
  misc_feature 1..3806: note = SARS-CoV-2/Wuhan/WIV05/2019__EPI_ISL_402128 spike protein mRNA gc mod (1-1147)(Q965C_S1003C) Foldon construct
  source 1..3806: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12657 - RNA, 3806 nt, synthetic construct
  misc_feature 1..3806: note = SARS-CoV-2/Wuhan/WIV05/2019__EPI_ISL_402128 spike protein mRNA gc mod (1-1147)(F970C_G999C) Foldon construct
  source 1..3806: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12658 - RNA, 3806 nt, synthetic construct
  misc_feature 1..3806: note = SARS-CoV-2/Wuhan/WIV05/2019__EPI_ISL_402128 spike protein mRNA gc mod (1-1147)(A972C_R995C) Foldon construct
  source 1..3806: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12659 - RNA, 3806 nt, synthetic construct
  misc_feature 1..3806: note = SARS-CoV-2/Wuhan/WIV05/2019__EPI_ISL_402128 spike protein mRNA gc mod (1-1147)(A890C_V1040C) Foldon construct
  source 1..3806: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12660 - RNA, 3806 nt, synthetic construct
  misc_feature 1..3806: note = SARS-CoV-2/Wuhan/WIV05/2019__EPI_ISL_402128 spike protein mRNA gc mod (1-1147)(T874C_S1055C) Foldon construct
  source 1..3806: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12661 - RNA, 4178 nt, synthetic construct
  misc_feature 1..4178: note = SARS-CoV-2/Wuhan/WIV05/2019__EPI_ISL_402128 spike protein mRNA gc mod (1-1147) WhcAg construct
  source 1..4178: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12662 - RNA, 4178 nt, synthetic construct
  misc_feature 1..4178: note = SARS-CoV-2/Wuhan/WIV05/2019__EPI_ISL_402128 spike protein mRNA gc mod (1-1147)(K986P_V987P) WhcAg construct
  source 1..4178: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12663 - RNA, 4178 nt, synthetic construct
  misc_feature 1..4178: note = SARS-CoV-2/Wuhan/WIV05/2019__EPI_ISL_402128 spike protein mRNA gc mod (1-1147)(K986P_V987P_T887WN_A1020W) WhcAg construct
  source 1..4178: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12664 - RNA, 4178 nt, synthetic construct
  misc_feature 1..4178: note = SARS-CoV-2/Wuhan/WIV05/2019__EPI_ISL_402128 spike protein mRNA gc mod (1-1147)(K986P_V987P_P1069F) WhcAg construct
  source 1..4178: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12665 - RNA, 4178 nt, synthetic construct
  misc_feature 1..4178: note = SARS-CoV-2/Wuhan/WIV05/2019__EPI_ISL_402128 spike protein mRNA gc mod (1-1147)(K986P_V987P_ H1048Q_H1064N_ H1083N_H1101N) WhcAg construct
  source 1..4178: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12666 - RNA, 4178 nt, synthetic construct
  misc_feature 1..4178: note = SARS-CoV-2/Wuhan/WIV05/2019__EPI_ISL_402128 spike protein mRNA gc mod (1-1147)(I712C_T1077C) WhcAg construct
  source 1..4178: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12667 - RNA, 4178 nt, synthetic construct
  misc_feature 1..4178: note = SARS-CoV-2/Wuhan/WIV05/2019__EPI_ISL_402128 spike protein mRNA gc mod (1-1147)(I714C_Y1110C) WhcAg construct
  source 1..4178: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12668 - RNA, 4178 nt, synthetic construct
  misc_feature 1..4178: note = SARS-CoV-2/Wuhan/WIV05/2019__EPI_ISL_402128 spike protein mRNA gc mod (1-1147)(P715C_P1069C) WhcAg construct
  source 1..4178: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12669 - RNA, 4178 nt, synthetic construct
  misc_feature 1..4178: note = SARS-CoV-2/Wuhan/WIV05/2019__EPI_ISL_402128 spike protein mRNA gc mod (1-1147)(G889C_L1034C) WhcAg construct
  source 1..4178: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12670 - RNA, 4178 nt, synthetic construct
  misc_feature 1..4178: note = SARS-CoV-2/Wuhan/WIV05/2019__EPI_ISL_402128 spike protein mRNA gc mod (1-1147)(I909C_Y1047C) WhcAg construct
  source 1..4178: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12671 - RNA, 4178 nt, synthetic construct
  misc_feature 1..4178: note = SARS-CoV-2/Wuhan/WIV05/2019__EPI_ISL_402128 spike protein mRNA gc mod (1-1147)(Q965C_S1003C) WhcAg construct
  source 1..4178: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12672 - RNA, 4178 nt, synthetic construct
  misc_feature 1..4178: note = SARS-CoV-2/Wuhan/WIV05/2019__EPI_ISL_402128 spike protein mRNA gc mod (1-1147)(F970C_G999C) WhcAg construct
  source 1..4178: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12673 - RNA, 4178 nt, synthetic construct
  misc_feature 1..4178: note = SARS-CoV-2/Wuhan/WIV05/2019__EPI_ISL_402128 spike protein mRNA gc mod (1-1147)(A972C_R995C) WhcAg construct
  source 1..4178: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12674 - RNA, 4178 nt, synthetic construct
  misc_feature 1..4178: note = SARS-CoV-2/Wuhan/WIV05/2019__EPI_ISL_402128 spike protein mRNA gc mod (1-1147)(A890C_V1040C) WhcAg construct
  source 1..4178: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12675 - RNA, 4178 nt, synthetic construct
  misc_feature 1..4178: note = SARS-CoV-2/Wuhan/WIV05/2019__EPI_ISL_402128 spike protein mRNA gc mod (1-1147)(T874C_S1055C) WhcAg construct
  source 1..4178: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12676 - RNA, 4039 nt, synthetic construct
  misc_feature 1..4039: note = SARS-CoV-2/Wuhan/WIV05/2019__EPI_ISL_402128 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12677 - RNA, 4027 nt, synthetic construct
  misc_feature 1..4027: note = SARS-CoV-2/bat/Yunnan/RaTG13/2013__EPI_ISL_402131 spike protein mRNA wt (1-1269)
  source 1..4027: mol_type = other RNA
aggagaaagcttaccatgtttgtttttcttgttttattgccactagtttctagtcagtgtgttaatctaacaactagaactcagttacctcctgcatacaccaactcatccacccgtggtgtctattaccctgacaaagttttcagatcttcagttttacatttaactcaggatttgtttttacctttcttctccaatgtgacctggttccatgctatacatgtttcagggaccaatggtattaaaaggtttgataacccagttctgccattcaacgatggcgtctattttgcttccactgagaagtctaatataataagaggatggatttttggtactaccttagattcgaagacccagtctctacttattgttaataacgctactaatgttgttattaaagtctgtgaatttcaattttgtaatgatccatttttgggtgtttattaccacaaaaacaacaaaagttggatggaaagtgagttcagagtttactctagtgcgaataattgcacttttgagtatgtctctcagccttttcttatggaccttgaaggaaaacagggtaatttcaaaaatcttagggaattcgtgtttaagaatattgatggttatttcaaaatatattctaaacatacgcctattaatttagtgcgtgatcttccccctggtttttcagctttagaaccattggtagatctgccaataggtattaacatcactaggtttcaaactttacttgctttacatagaagctatttgactcctggtgattcttcttcaggttggacagctggtgctgcagcttattatgtgggttatcttcaaccaaggacttttctactaaaatataatgagaatggaaccattacagatgctgtagactgtgcacttgaccctctttcagaaacaaagtgtacgttaaaatccttcactgttgaaaaaggaatttatcaaacctctaactttagagtccaaccaacagattctattgttagattcccaaatattacaaacttatgtccttttggtgaagtttttaacgccaccacattcgcatcagtttatgcttggaacagaaagagaattagcaactgtgttgctgattactctgtcctatataattccacttcattttctacctttaaatgttatggagtgtctcctactaaattaaatgatctctgctttactaatgtttatgcagactcatttgtgattacaggtgatgaagtcagacaaattgcgccaggacaaactggaaagattgctgactacaattataaactaccagatgattttactggttgtgttatagcttggaattctaagcatattgatgcaaaagagggcggtaattttaactatctttaccgtctctttagaaaagctaatcttaaaccctttgagagggatatctcaactgaaatttaccaagcaggcagcaaaccttgtaatggtcaaactggtctaaattgctactacccactttatagatatggattttaccctactgatggtgttggtcaccaaccttatagggtagtagtactttcttttgaacttctaaatgcaccagcaactgtttgtggacctaagaagtctactaacttggttaaaaataaatgtgtcaatttcaactttaatggtttaactggcacaggtgtcctcacagagtctaataaaaagtttctacctttccaacaatttggtagagacattgcagacactactgatgccgtccgtgatccacagacacttgagattcttgacattacaccatgttcttttggtggtgtcagtgttataacacctggaacaaatgcctctaaccaggttgctgttctttatcaggatgttaactgcacagaagtccctgttgctatccatgcagaccaacttactcccacttggcgtgtttactccacaggttctaatgtttttcaaacacgtgcaggttgtttaataggggctgaacatgtcaataactcgtatgagtgtgacatacctattggtgcaggaatatgcgccagttatcagactcaaactaattcacgtagtgtggccagtcaatctattattgcctacactatgtcacttggtgcagaaaattcagttgcttattctaataactctattgccatacctacaaattttactattagtgtgaccactgaaattctacctgtgtctatgacaaagacatcggtagactgtacaatgtatatttgtggtgattcaactgagtgcagcaaccttttgttgcaatatggtagtttttgcacacaattaaatcgtgctttaactggaatagctgttgaacaggacaaaaatactcaagaagtttttgctcaagttaaacaaatttataagacaccaccaattaaagattttggtggtttcaatttttcacaaatattaccagatccatcaaaaccaagcaagaggtcatttattgaggatttacttttcaataaagtgacacttgctgatgctggcttcatcaaacaatatggtgattgccttggtgatattgctgctagggatcttatttgtgctcaaaagttcaatggccttactgttctgccacctttgctcacagatgaaatgatcgctcaatacacttctgcactattagcaggtacaatcacttctggttggacttttggtgcaggtgctgctttacaaataccatttgccatgcaaatggcttataggtttaatggtattggagttacacagaatgttctctatgagaaccaaaaattgattgccaaccagtttaatagtgctattggcaaaattcaagactcactttcttctacagcaagtgcacttggaaaacttcaagatgttgtcaaccaaaatgcacaagctttaaacacgcttgttaaacaacttagctccaattttggagctatttctagcgtgttaaatgatatcctttcacgtctcgacaaagttgaggctgaagtgcagattgacaggttgatcacaggcagacttcaaagcttgcagacatatgtgactcaacaattaattagagctgcagaaatcagagcttctgccaatcttgctgctactaaaatgtcagagtgtgtactcggacaatcaaaaagagttgatttttgtggaaaaggctatcatcttatgtctttccctcagtcagcacctcatggtgtagtcttcttgcatgtgacatatgtccctgcacaagaaaagaacttcacaactgctcctgccatttgtcatgatggaaaagcacactttccacgtgaaggtgttttcgtttcaaatggcacacactggtttgttacacaaaggaatttttatgaaccacaaattattacaacagacaacacatttgtctctggtagctgtgatgttgtaataggaattgtcaacaacacagtttatgatcctttgcaaccagaacttgattcattcaaggaggagttggataaatactttaaaaatcatacatcacctgatgtagatttaggtgacatttctggcattaatgcttcagttgtcaatattcaaaaggaaattgaccgcctcaatgaggttgccaaaaatctaaatgaatctctcatcgatctccaagaacttggaaagtatgaacagtatataaaatggccatggtacatttggctaggttttatagctggcttgattgccataataatggtcacgattatgctttgctgtatgaccagttgctgcagttgtctcaagggctgttgttcttgcggatcttgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12678 - RNA, 4039 nt, synthetic construct
  misc_feature 1..4039: note = SARS-CoV-2/Wuhan/HBCDC-HB-01/2019__EPI_ISL_402132 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctatcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12679 - RNA, 4039 nt, synthetic construct
  misc_feature 1..4039: note = SARS-CoV-2/Guangdong/20SF028/2020__EPI_ISL_403936 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttatattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12680 - RNA, 4039 nt, synthetic construct
  misc_feature 1..4039: note = SARS-CoV-2/Shenzhen/SZTH-001/2020__EPI_ISL_406592 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttctaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgggccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12681 - RNA, 4039 nt, synthetic construct
  misc_feature 1..4039: note = SARS-CoV-2/Shenzhen/SZTH-004/2020__EPI_ISL_406595 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttgggacaggaagagaatcagcaactgtgttgcttattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggcatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12682 - RNA, 4039 nt, synthetic construct
  misc_feature 1..4039: note = SARS-CoV-2/France/IDF0372/2020__EPI_ISL_406596 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctttcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12683 - RNA, 4039 nt, synthetic construct
  misc_feature 1..4039: note = SARS-CoV-2/Australia/VIC01/2020__EPI_ISL_406844 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaaggtatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12684 - RNA, 4039 nt, synthetic construct
  misc_feature 1..4039: note = SARS-CoV-2/Germany/BavPat1/2020__EPI_ISL_406862 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12685 - RNA, 4039 nt, synthetic construct
  misc_feature 1..4039: note = SARS-CoV-2/Wuhan/HBCDC-HB-02/2020__EPI_ISL_412978 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaattttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12686 - RNA, 4039 nt, synthetic construct
  misc_feature 1..4039: note = SARS-CoV-2/Australia/QLD02/2020__EPI_ISL_407896 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacttgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12687 - RNA, 4039 nt, synthetic construct
  misc_feature 1..4039: note = SARS-CoV-2/India/1-31/2020__EPI_ISL_413523 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgttattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12688 - RNA, 4039 nt, synthetic construct
  misc_feature 1..4039: note SARS-CoV-2/Guangdong/GD2020087-P0008/2020__EPI_ISL_413863 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagagaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12689 - RNA, 4039 nt, synthetic construct
  misc_feature 1..4039: note = SARS-CoV-2/Sweden/01/2020__EPI_ISL_411951 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattgtggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12690 - RNA, 4039 nt, synthetic construct
  misc_feature 1..4039: note = SARS-CoV-2/Tianmen/HBCDC-HB-07/2020__EPI_ISL_412983 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatcttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12691 - RNA, 4039 nt, synthetic construct
  misc_feature 1..4039: note = SARS-CoV-2/Hong Kong/case42_VM20002493/2020__EPI_ISL_414527 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttgctattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12692 - RNA, 4039 nt, synthetic construct
  misc_feature 1..4039: note = SARS-CoV-2/USA/CruiseA-23/2020__EPI_ISL_414482 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaagtaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12693 - RNA, 4039 nt, synthetic construct
  misc_feature 1..4039: note = SARS-CoV-2/Hong Kong/case85_VM20002868/2020__EPI_ISL_414519 spike protein mRNA wt (1-1273)
  source 1..4039: mol_type = other RNA
aggagaaagcttaccatgtttgtttttcttgttttagtgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12694 - RNA, 4039 nt, synthetic construct
  misc_feature 1..4039: note = SARS-CoV-2/England/200990660/2020__EPI_ISL_414523 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagctagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12695 - RNA, 4039 nt, synthetic construct
  misc_feature 1..4039: note = SARS-CoV-2/Australia/NSW09/2020__EPI_ISL_413595 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttctttcacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12696 - RNA, 4039 nt, synthetic construct
  misc_feature 1..4039: note = SARS-CoV-2/Australia/NSW10/2020__EPI_ISL_413596 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgcttcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12697 - RNA, 4039 nt, synthetic construct
  misc_feature 1..4039: note SARS-CoV-2/Switzerland/1000477797/2020__EPI_ISL_413023 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaacatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12698 - RNA, 4039 nt, synthetic construct
  misc_feature 1..4039: note = SARS-CoV-2/Belgium/BA-02291/2020__EPI_ISL_415159 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaggtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacctgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttctgcagcacctgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12699 - RNA, 4039 nt, synthetic construct
  misc_feature 1..4039: note = SARS-CoV-2/USA/WA8-UW5/2020__EPI_ISL_413486 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaatatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12700 - RNA, 4039 nt, synthetic construct
  misc_feature 1..4039: note = SARS-CoV-2/England/20102000506/2020__EPI_ISL_415147 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggttattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12701 - RNA, 4039 nt, synthetic construct
  misc_feature 1..4039: note = SARS-CoV-2/Belgium/VAG-03013/2020__EPI_ISL_415155 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaactgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12702 - RNA, 4039 nt, synthetic construct
  misc_feature 1..4039: note = SARS-CoV-2/Belgium/BC-03016/2020__EPI_ISL_415157 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcacctgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12703 - RNA, 4039 nt, synthetic construct
  misc_feature 1..4039: note = SARS-CoV-2/Germany/BavPat3/2020__EPI_ISL_414521 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaacaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12704 - RNA, 4039 nt, synthetic construct
  misc_feature 1..4039: note = SARS-CoV-2/France/HF1805/2020__EPI_ISL_414628 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggagttgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12705 - RNA, 4039 nt, synthetic construct
  misc_feature 1..4039: note SARS-CoV-2/Netherlands/ZuidHolland_9/2020__EPI_ISL_414445 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgtacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12706 - RNA, 4039 nt, synthetic construct
  misc_feature 1..4039: note = SARS-CoV-2/Finland/FIN03032020A/2020__EPI_ISL_413602 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatatcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12707 - RNA, 4039 nt, synthetic construct
  misc_feature 1..4039: note = SARS-CoV-2/France/GE1977/2020__EPI_ISL_414632 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcacttttttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12708 - RNA, 4039 nt, synthetic construct
  misc_feature 1..4039: note = SARS-CoV-2/Finland/FIN-313/2020__EPI_ISL_414641 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttaaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatctatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12709 - RNA, 4039 nt, synthetic construct
  misc_feature 1..4039: note SARS-CoV-2/Netherlands/ZuidHolland_2/2020__EPI_ISL_414556 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctcttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12710 - RNA, 4039 nt, synthetic construct
  misc_feature 1..4039: note = SARS-CoV-2/USA/WA-UW31/2020__EPI_ISL_414618 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgctgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12711 - RNA, 4039 nt, synthetic construct
  misc_feature 1..4039: note = SARS-CoV-2/South Korea/SNU01/2020__EPI_ISL_411929 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttgggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12712 - RNA, 4039 nt, synthetic construct
  misc_feature 1..4039: note = SARS-CoV-2/China/WF0004/2020__EPI_ISL_413694 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggacggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagatttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12713 - RNA, 4039 nt, synthetic construct
  misc_feature 1..4039: note = SARS-CoV-2/China/WF0028/2020__EPI_ISL_413791 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagaatcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12714 - RNA, 4039 nt, synthetic construct
  misc_feature 1..4039: note = SARS-CoV-2/2019-nCoV/USA-CruiseA-18/2020__MT159716.1 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttaagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12715 - RNA, 4039 nt, synthetic construct
  misc_feature 1..4039: note SARS-CoV-2/SARS-CoV-2/Yunnan-01/human/2020/CHN__MT049951.1 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcaaacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12716 - RNA, 4039 nt, synthetic construct
  misc_feature 1..4039: note = SARS-CoV-2/USA/WA-UW292/2020__EPI_ISL_418077 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccagtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12717 - RNA, 4039 nt, synthetic construct
  misc_feature 1..4039: note = SARS-CoV-2/Iceland/192/2020__EPI_ISL_417819 spike protein mRNA wt (1-1273)
  source 1..4039: mol_type = other RNA
aggagaaagcttaccatgtttgttttttttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12718 - RNA, 4039 nt, synthetic construct
  misc_feature 1..4039: note = SARS-CoV-2/Belgium/ULG-6939/2020__EPI_ISL_417020 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgtttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12719 - RNA, 4039 nt, synthetic construct
  misc_feature 1..4039: note = SARS-CoV-2/France/HF2496/2020__EPI_ISL_418231 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgttgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12720 - RNA, 4039 nt, synthetic construct
  misc_feature 1..4039: note = SARS-CoV-2/USA/WA-UW291/2020__EPI_ISL_418076 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaatactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12721 - RNA, 4039 nt, synthetic construct
  misc_feature 1..4039: note = SARS-CoV-2/Portugal/PT0034/2020__EPI_ISL_418019 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtattaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12722 - RNA, 4039 nt, synthetic construct
  misc_feature 1..4039: note = SARS-CoV-2/Iceland/202/2020__EPI_ISL_417750 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatccctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12723 - RNA, 4039 nt, synthetic construct
  misc_feature 1..4039: note = SARS-CoV-2/USA/WA-UW261/2020__EPI_ISL_418046 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttacatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12724 - RNA, 4039 nt, synthetic construct
  misc_feature 1..4039: note = SARS-CoV-2/Portugal/PT0035/2020__EPI_ISL_418020 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatatttctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12725 - RNA, 4039 nt, synthetic construct
  misc_feature 1..4039: note = SARS-CoV-2/USA/NY-NYUMC7/2020__EPI_ISL_418192 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttatcaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12726 - RNA, 4039 nt, synthetic construct
  misc_feature 1..4039: note = SARS-CoV-2/Iceland/189/2020__EPI_ISL_417709 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcaccaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12727 - RNA, 4039 nt, synthetic construct
  misc_feature 1..4039: note = SARS-CoV-2/Australia/NSW56/2020__EPI_ISL_417408 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagattcatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12728 - RNA, 4039 nt, synthetic construct
  misc_feature 1..4039: note = SARS-CoV-2/Iceland/280/2020__EPI_ISL_417608 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcatactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12729 - RNA, 4039 nt, synthetic construct
  misc_feature 1..4039: note = SARS-CoV-2/Iceland/247/2020__EPI_ISL_417575 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaattgtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12730 - RNA, 4039 nt, synthetic construct
  misc_feature 1..4039: note = SARS-CoV-2/Iceland/238/2020__EPI_ISL_417566 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgttggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12731 - RNA, 4039 nt, synthetic construct
  misc_feature 1..4039: note = SARS-CoV-2/Greece/16/2020__EPI_ISL_418265 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatgttgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12732 - RNA, 4039 nt, synthetic construct
  misc_feature 1..4039: note = SARS-CoV-2/Iceland/319/2020__EPI_ISL_417648 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatagaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12733 - RNA, 4039 nt, synthetic construct
  misc_feature 1..4039: note = SARS-CoV-2/Congo/94/2020__EPI_ISL_417947 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatatacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12734 - RNA, 4039 nt, synthetic construct
  misc_feature 1..4039: note = SARS-CoV-2/Congo/158/2020__EPI_ISL_417950 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttttgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12735 - RNA, 4039 nt, synthetic construct
  misc_feature 1..4039: note = SARS-CoV-2/USA/UT-00034/2020__EPI_ISL_417977 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattactacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12736 - RNA, 4039 nt, synthetic construct
  misc_feature 1..4039: note = SARS-CoV-2/USA/UT-00033/2020__EPI_ISL_417976 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggtttgacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12737 - RNA, 4039 nt, synthetic construct
  misc_feature 1..4039: note = SARS-CoV-2/USA/WI-13/2020__EPI_ISL_417516 spike protein mRNA wt (1-1273)
  source 1..4039: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtcctaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12738 - RNA, 4036 nt, synthetic construct
  misc_feature 1..4036: note = SARS-CoV-2/India/1-27/2020__EPI_ISL_413522 spike protein mRNA wt (1-1272)
  source 1..4036: mol_type = other RNA
aggagaaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcatacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12739 - RNA, 4021 nt, synthetic construct
  misc_feature 1..4021: note = SARS-CoV-2/pangolin/Guangxi/P4L/2017__EPI_ISL_410538 spike protein mRNA wt (1-1267)
  source 1..4021: mol_type = other RNA
aggagaaagcttaccatgtttgtttttctttttgtcttgcctttggtttccagtcaatgtgtcaatttgaccacaagaactggaataccgccaggttataccaattcatctactagaggtgtctattatccagacaaagtttttaggtcttcaattttacatcttacacaagaccttttcttacctttcttttctaatgttacttggtttaacaccataaattatcaaggaggctttaagaagtttgacaatcctgttttaccatttaatgatggtgtttactttgcctccacggaaaagtccaatattatacgcggttggatttttggaacaacacttgatgccagaactcaatctcttctaatagttaacaacgcaaccaatgttgttatcaaagtatgtgagtttcagttttgcactgatccatttttaggtgtttactatcataacaacaataaaacatgggttgaaaatgagtttagagtttattcaagtgccaacaattgcactttcgaatacatttctcaaccttttcttatggaccttgaaggaaagcaaggtaattttaagaaccttagagagtttgtgtttaaaaatgttgatggttatttcaagatttactctaaacacacacctattgatttagtgcgcgacctccccagaggttttgctgcattggaaccactggtggacctccctataggtattaatattaccagattccaaacattgcttgctttacatagaagttatcttacacctggtaatctagaaagtggctggacaactggagctgctgcttactatgtaggttacctacaacagaggacttttctcttaagttacaatcaaaatggaaccattacagatgctgttgattgttcactagaccctctttcagagacaaagtgcacattaaaatccctaacagttgaaaaaggaatttaccagacttctaacttcagagttcaaccaacaatcagtatagttagatttcctaatattacaaacttatgtccatttggagaagtgtttaacgcatccaaatttgcatcagtttatgcttggaacaggaagagaattagcaattgtgttgctgattactctgtactttataactctacatcattttccacttttaaatgttatggagtttcacctacaaaactcaatgacctttgcttcaccaatgtgtatgcagactcatttgttgttaaaggtgacgaggttagacaaatagcacccggacaaactggtgttattgctgattataactataagctgccagatgattttactggttgtgttattgcttggaactcagttaagcaagatgctttgactggtggtaattatggttatttgtatagattatttagaaagtctaagcttaaaccatttgagagagatatttccactgaaatataccaagccggcagcacaccctgtaacggtcaagttggtctaaattgttattatcctcttgaaaggtatggttttcacccaactacaggtgttaactaccaaccttttagagtggttgttttatcatttgagttacttaatggaccagctactgtttgtggacccaaattgtctacaacactagttaaagacaaatgtgtcaatttcaactttaacggtttaactggcacaggtgttcttacaacatctaagaaacagtttctgccttttcaacaatttggtagagacatctctgacactactgatgctgtccgtgacccacagacacttgaaatacttgacattaccccttgctcttttggaggagttagtgtgataacaccaggtacaaacacttctaatcaagtggctgtactttaccaagatgttaactgtactgaagtgcctatggccattcatgcagaacaacttacacctgcctggcgtgtttactctgcaggagcaaatgtgtttcaaacaagagcaggctgtttagtaggtgctgagcatgtcaacaattcttatgaatgtgacattccagtcggtgctggcatatgtgcaagttaccattccatgtcatcattgcgtagtgtcaaccagcgttcaatcattgcttacactatgtctttaggtgcagaaaattcagttgcttattctaataattcaattgccatacctactaattttacaataagtgttaccacagaaattctaccagtgtcaatgactaagacttctgtagattgtactatgtacatctgtggagattcaattgagtgtagtaatttattgctacaatatggcagtttttgcacacaattaaaccgtgctttgactgggattgctgttgaacaagacaaaaacacacaagaagtttttgcccaggttaaacaaatctacaaaacaccacctattaaagattttggtggctttaacttttcacaaatattgccagatccatcaaaaccaagcaagaggtcatttattgaggatttactcttcaacaaagtgacacttgctgatgctggcttcatcaaacaatatggtgattgccttggtgatattgctgctagagatctcatctgtgcacaaaagttcaatggactcacggttctaccgcctttgctcacagatgaaatgattgctcaatacacttctgcactacttgctggaacaatcacctcaggttggacctttggtgcaggagctgctttacaaataccctttgcaatgcaaatggcttacaggtttaatggcattggagtcactcagaatgttctatatgagaatcagaaattaattgccaatcagttcaacagtgctattggcaaaatacaggattcactttcatctacggctagtgcacttggtaaacttcaagacgtcgtaaatcaaaatgcacaggctttaaacacacttgtcaaacaacttagttccaattttggagctatttcgagtgtgcttaatgatattctttcacgtcttgacaaagttgaggctgaagtgcaaattgataggttaatcacaggaagactacagagtcttcaaacttatgtgacacaacaattaatcagagcagcagaaatcagagcttctgctaatcttgctgcaacaaaaatgtctgagtgcgtactcggacaatctaaaagagttgatttttgtggaaaaggctaccatttaatgtctttccctcaatcagcaccgcatggtgttgttttcttgcatgttacttatgtacctgcacaagaaaagaactttactactgctcctgctatttgtcatgaaggaaaagcacacttccctcgtgaaggtgtcttcgtttcaaatggcactcattggtttattacacaaaggaatttttatgaacctcaaattattaccactgacaacacattcgtctctggtagctgtgatgttgtaattggaatagtcaacaacacagtttatgatcctttgcaacccgagcttgactcatttaaggaggagttagacaaatacttcaaaaatcacacatcaccagatgttgatcttggcgacatatctggcataaatgcttcggtcgtcaacatacaaaaagaaattgaccgcctcaatgaggttgccaaaaatttgaatgaatcacccattgacctacaagagcttggaaaatatgagcaatacatcaaatggccttggtacatttggcttggttttatagctgggctaattgctatcattatggtcacaatcatgctatgttgtatgactagttgctgtagttgcctcaagggttgttgctcttgcggttcctgctgcaaatttgatgaagacgattcagaacctgttctgaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12740 - RNA, 4021 nt, synthetic construct
  misc_feature 1..4021: note = SARS-CoV-2/pangolin/Guangxi/P5L/2017__EPI_ISL_410540 spike protein mRNA wt (1-1267)
  source 1..4021: mol_type = other RNA
aggagaaagcttaccatgtttgtttttctttttgtcttgcctttggtttccagtcaatgtgtcaatttgaccacaagaactggaataccgccaggttataccaattcatctactagaggtgtctattatccagacaaagtttttaggtcttcaattttacatcttacacaagaccttttcttacctttcttttctaatgttacttggtttaacaccataaattatcaaggaggctttaagaagtttgacaatcctgttttaccatttaatgatggtgtttactttgcctccacggaaaagtccaatattatacgcggttggatttttggaacaacacttgatgccagaactcaatctcttctaatagttaacaacgcaaccaatgttgttatcaaagtatgtgagtttcagttttgcactgatccatttttaggtgtttactatcataacaacaataaaacatgggttgaaaatgagtttagagtttattcaagtgccaacaattgcactttcgaatacatttctcaaccttttcttatggaccttgaaggaaagcaaggtaattttaagaaccttagagagtttgtgtttaaaaatgttgatggttatttcaagatttactctaaacacacacctattgatttagtgcgcgacctccccagaggttttgctgcattggaaccactggtggacctccctataggtattaatattaccagattccaaacattgcttgctttacatagaagttatcttacacctggtaagctagaaagtggctggacaactggagctgctgcttactatgtaggttacctacaacagaggacttttctcttaagttacaatcaaaatggaaccattacagatgctgttgattgttcactagaccctctttcagagacaaagtgcacattaaaatccctaacagttgaaaaaggaatttaccagacttctaacttcagagttcaaccaacaatcagtatagttagatttcctaatattacaaacttatgtccatttggagaagtgtttaacgcatccaaatttgcatcagtttatgcttggaacaggaagagaattagcaattgtgttgctgattactctgtactttataactctacatcattttccacttttaaatgttatggagtttcacctacaaaactcaatgacctttgcttcaccaatgtgtatgcagactcatttgttgttaaaggtgacgaggttagacaaatagcacccggacaaactggtgttattgctgattataactataagctgccagatgattttactggttgtgttattgcttggaactcagttaagcaagatgctttgactggtggtaattatggttatttgtatagattatttagaaagtctaagcttaaaccatttgagagagatatttccactgaaatataccaagccggcagcacaccctgtaacggtcaagttggtctaaattgttattatcctcttgaaaggtatggttttcacccaactacaggtgttaactaccaaccttttagagtggttgttttatcatttgagttacttaatggaccagctactgtttgtggacccaaattgtctacaacactagttaaagacaaatgtgtcaatttcaactttaacggtttaactggcacaggtgttcttacaacatctaagaaacagtttctgccttttcaacaatttggtagagacatctctgacactactgatgctgtccgtgacccacagacacttgaaatacttgacattaccccttgctcttttggaggagttagtgtgataacaccaggtacaaacacttctaatcaagtggctgtactttaccaagatgttaactgtactgaagtgcctatggccattcatgcagaacaacttacacctgcctggcgtgtttactctgcaggagcaaatgtgtttcaaacaagagcaggctgtttagtaggtgctgagcatgtcaacaattcttatgaatgtgacattccagtcggtgctggcatatgtgcaagttaccattccatgtcatcatttcgtagtgtcaaccagcgttcaatcattgcttacactatgtctttaggtgcagaaaattcagttgcttattctaataattcaattgccatacctactaattttacaataagtgttaccacagaaattctaccagtgtcaatgactaagacttctgtagattgtactatgtacatctgtggagattcaattgagtgtagtaatttattgctacaatatggcagtttttgcacacaattaaaccgtgctttgactgggattgctgttgaacaagacaaaaacacacaagaagtttttgcccaggttaaacaaatctacaaaacaccacctattaaagattttggtggctttaacttttcacaaatattgccagatccatcaaaaccaagcaagaggtcatttattgaggatttactcttcaacaaagtgacacttgctgatgctggcttcatcaaacaatatggtgattgccttggtgatattgctgctagagatctcatctgtgcacaaaagttcaatggactcacggttctaccgcctttgctcacagatgaaatgattgctcaatacacttctgcactacttgctggaacaatcacctcaggttggacctttggtgcaggagctgctttacaaataccctttgcaatgcaaatggcttacaggtttaatggcattggagtcactcagaatgttctatatgagaatcagaaattaattgccaatcagttcaacagtgctattggcaaaatacaggattcactttcatctacggctagtgcacttggtaaacttcaagacgtcgtaaatcaaaatgcacaggctttaaacacacttgtcaaacaacttagttccaattttggagctatttcgagtgtgcttaatgatattctttcacgtcttgacaaagttgaggctgaagtgcaaattgataggttaatcacaggaagactacagagtcttcaaacttatgtgacacaacaattaatcagagcagcagaaatcagagcttctgctaatcttgctgcaacaaaaatgtctgagtgcgtactcggacaatctaaaagagttgatttttgtggaaaaggctaccatttaatgtctttccctcaatcagcaccgcatggtgttgttttcttgcatgttacttatgtacctgcacaagaaaagaactttactactgctcctgctatttgtcatgaaggaaaagcacacttccctcgtgaaggtgtcttcgtttcaaatggcactcattggtttattacacaaaggaatttttatgaacctcaaattattaccactgacaacacattcgtctctggtagctgtgatgttgtaattggaatagtcaacaacacagtttatgatcctttgcaacccgagcttgactcatttaaggaggagttagacaaatacttcaaaaatcacacatcaccagatgttgatcttggcgacatatctggcataaatgcttcggtcgtcaacatacaaaaagaaattgaccgcctcaatgaggttgccaaaaatttgaatgaatcactcattgacctacaagagcttggaaaatatgagcaatacatcaaatggccttggtacatttggcttggttttatagctgggctaattgctatcattatggtcacaatcatgctatgttgtatgactagttgctgtagttgcctcaagggttgttgctcttgcggttcctgctgcaaatttgatgaagacgattcagaacctgttctgaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12741 - RNA, 4021 nt, synthetic construct
  misc_feature 1..4021: note = SARS-CoV-2/pangolin/Guangxi/P5E/2017__EPI_ISL_410541 spike protein mRNA wt (1-1267)
  source 1..4021: mol_type = other RNA
aggagaaagcttaccatgtttgtttttctttttgtcttgcctttggtttccagtcaatgtgtcaatttgaccacaagaactggaataccgccaggttataccaattcatctactagaggtgtctattatccagacaaagtttttaggtcttcaattttacatcttacacaagaccttttcttacctttcttttctaatgttacttggtttaacaccataacttatcaaggaggctctaagaagtttgacaatcctgttttaccatttaatgatggtgtttactttgcctccacggaaaagtccaatattatacgcggttggatttttggaacaacacttgatgccagaactcaatctcttctaatagttaacaacgcaaccaatgttgttatcaaagtatgtgagtttcagttttgcactgatccatttttaggtgtttactatcataacaacaataaaacatgggttgaaaatgagtttagagtttattcaagtgccaacaattgcactttcgaatacatttctcaaccttttcttatggaccttgaaggaaagcaaggtaattttaagaaccttagagagtttgtgtttaaaaatgttgatggttatttcaagatttactctaaacacacacctattgatttagtgcgcgacctccccagaggttttgctgcattggaaccactggtggacctccctataggtattaatattaccagattccaaacattgcttgctttacatagaagttatcttacacctggtaagctagaaagtggctggacaactggagctgctgcttactatgtaggttacctacaacagaggacttttctcttaagttacaatcaaaatggaaccattacagatgctgttgattgttcactagaccctctttcagagacaaagtgcacattaaaatccctaacagttgaaaaaggaatttaccagacttctaacttcagagttcaaccaacaatcagtatagttagatttcctaatattacaaacttatgtccatttggagaagtgtttaacgcatccaaatttgcatcagtttatgcttggaacaggaagagaattagcaattgtgttgctgattactctgtactttataactctacatcattttccacttttaaatgttatggagtttcacctacaaaactcaatgacctttgcttcaccaatgtgtatgcagactcatttgttgttaaaggtgacgaggttagacaaatagcacccggacaaactggtgttattgctgattataactataagctgccagatgattttactggttgtgttattgcttggaactcagttaagcaagatgctttgactggtgataattatggttatttgtatagattatttagaaagtctaagcttaaaccatttgagagagatatttccactgaaatataccaagccggcagcacaccctgtaacggtcaagttggtctaaattgttattatcctcttgaaaggtatggttttcacccaactacaggtgttaactaccaaccttttagagtggttgttttatcatttgagttacttaatggaccagctactgtttgtggacccaaattgtctacaacactagttaaagacaaatgtgtcaatttcaactttaacggtttaactggcacaggtgttcttacaacatctaagaaacagtttctgccttttcaacaatttggtagagacatctctgacactactgatgctgtccgtgacccacagacacttgaaatacttgacattaccccttgctcttttggaggagttagtgtgataacaccaggtacaaacacttctaatcaagtggctgtactttaccaagatgttaactgtactgaagtgcctatggccattcatgcagaacaacttacacctgcctggcgtgtttactctgcaggagcaaatgtgtttcaaacaagagcaggctgtttagtaggtgctgagcatgtcaacaattcttatgaatgtgacattccagtcggtgctggcatatgtgcaagttaccattccatgtcatcatttcgtagtgtcaaccagcgttcaatcattgcttacactatgtctttaggtgcagaaaattcagttgcttattctaataattcaattgccatacctactaattttacaataagtgttaccacagaaattctaccagtgtcaatgactaagacttctgtagattgtactatgtacatctgtggagattcaattgagtgtagtaatttattgctacaatatggcagtttttgcacacaattaaaccgtgctttgactgggattgctgttgaacaagacaaaaacacacaagaagtttttgcccaggttaaacaaatctacaaaacaccacctattaaagattttggtggctttaacttttcacaaatattgccagatccatcaaaaccaagcaagaggtcatttattgaggatttactcttcaacaaagtgacacttgctgatgctggcttcatcaaacaatatggtgattgccttggtgatattgctgctagagatctcatctgtgcacaaaagttcaatggactcacggttctaccgcctttgctcacagatgaaatgattgctcaatacacttctgcactacttgctggaacaatcacctcaggttggacctttggtgcaggagctgctttacaaataccctttgcaatgcaaatggcttacaggtttaatggcattggagtcactcagaatgttctatatgagaatcagaaattaattgccaatcagttcaacagtgctattggcaaaatacaggattcactttcatctacggctagtgcacttggtaaacttcaagacgtcgtaaatcaaaatgcacaggctttaaacacacttgtcaaacaacttagttccaattttggagctatttcgagtgtgcttaatgatattctttcacgtcttgacaaagttgaggctgaagtgcaaattgataggttaatcacaggaagactacagagtcttcaaacttatgtgacacaacaattaatcagagcagcagaaatcagagcttctgctaatcttgctgcaacaaaaatgtctgagtgcgtactcggacaatctaaaagagttgatttttgtggaaaaggctaccatttaatgtctttccctcaatcagcaccgcatggtgttgttttcttgcatgttacttatgtacctgcacaagaaaagaactttactactgctcctgctatttgtcatgaaggaaaagcacacttccctcgtgaaggtgtcttcgtttcaaatggcactcattggtttattacacaaaggaatttttatgaacctcaaattattaccactgacaacacattcgtctctggtagctgtgatgttgtaattggaatagtcaacaacacagtttatgatcctttgcaacccgagcttgactcatttaaggaggagttagacaaatacttcaaaaatcacacatcaccagatgttgatcttggcgacatatctggcataaatgcttcggtcgtcaacatacaaaaagaaattgaccgcctcaatgaggttgccaaaaatttgaatgaatcactcattgacctacaagagcttggaaaatatgagcaatacatcaaatggccttggtacatttggcttggttttatagctgggctaattgctatcattatggtcacaatcatgctatgttgtatgactagttgctgtagttgcctcaagggttgttgctcttgcggttcctgctgcaaatttgatgaagacgattcagaacctgttctgaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12742 - RNA, 4015 nt, synthetic construct
  misc_feature 1..4015: note = SARS-CoV-2/pangolin/Guangxi/P1E/2017__EPI_ISL_410539 spike protein mRNA wt (1-1265)
  source 1..4015: mol_type = other RNA
aggagaaagcttaccatgtttgtttttctttttgtcttgcctttggtttccagtcaatgtgtcaatttgaccacaagaactggaatacagccaggttataccaattcatctactagaggtgtctattatccagacaaagtttttaggtcttcaattttacatcttacacaagaccttttcttacctttcttttctaatgttacttggtttaacaccataaattatcaaggaggctttaagaagtttgacaatcctgttttaccatttaatgatggtgtttactttgcctccacggaaaagtccaatattatacgcggttggatttttggaacaacacttgatgccagaactcaatctcttctaatagttaacaacgcaaccaatgttgttatcaaagtatgtgagtttcagttttgcactgatccatttttaggtgtttactatcataacaacaataaaacatgggttgaaaatgagtttagagtttattcaagtgccaacaattgcactttcgaatacatttctcaaccttttcttatggaccttgaaggaaagcaaggtaattttaagaaccttagagagtttgtgtttaaaaatgttgatggttatttcaagatttactctaaacacacacctattgatttagtgcgcgacctccccagaggttttgctgcattggaaccactggtggacctccctataggtattaatattaccagattccaaacattgcttgctttacatagaagttatcttacacctggtaagctagaaagtggctggacaactggagctgctgcttactatgtaggttacctacaacagaggacttttctcttaagttacaatcaaaatggaaccattacagatgctgttgattgttcactagaccctctttcagagacaaagtgcacattaaaatccctaacagttgaaaaaggaatttaccagacttctaacttcagagttcaaccaacaatcagtatagttagatttcctaatattacaaacttatgtccatttggagaagtgtttaacgcatccaaatttgcatcagtttatgcttggaacaggaagagaattagcaattgtgttgctgattactctgtactttataactctacatcattttccacttttaaatgttatggagtttcacctacaaaactcaatgacctttgcttcaccaatgtgtatgcagactcatttgttgttaaaggtgacgaggttagacaaatagcacccggacaaactggtgttattgctgattataactataagctgccagatgattttactggttgtgttattgcttggaactcagttaagcaagatgctttgactggtggtaattatttgtatagattatttagaaagtctaagcttaaaccatttgagagagatatttccactgaaatataccaagccggcagcacaccctgtaacggtcaagttggtctaaattgttattatcctcttgaaaggtatggttttcacccaactacaggtgttaactaccaaccttttagagtggttgttttatcatttgagttacttaatggaccagctactgtttgtggacccaaattgtctacaacactagttaaagacaaatgtgtcaatttcaactttaacggtttaactggcacaggtgttcttacaacatctaagaaacagtttctgccttttcaacaatttggtagagacatctctgacactactgatgctgtccgtgacccacagacacttgaaatacttgacattaccccttgctcttttggaggagttagtgtgataacaccaggtacaaacacttctaatcaagtggctgtactttaccaagatgttaactgtactgaagtgcctatggccattcatgcagaacaacttacacctgcctggcgtgtttactctgcaggagcaaatgtgtttcaaacaagagcaggctgtttagtaggtgctgagcatgtcaacaattcttatgaatgtgacattccagtcggtgctggcatatgtgcaagttaccattccatgtcatcattgcgtagtgtcaaccagcgttcaatcattgcttacactatgtctttaggtgcagaaaattcagttgcttattctaataattcaattgccatacctactaattttacaataagtgttaccacagaaattctaccagtgtcaatgactaagacttctgtagattgtactatgtacatctgtggagattcaattgagtgtagtaatttattgctacaatatggcagtttttgcacacaattaaaccgtgctttgactgggattgctgttgaacaagacaaaaacacacaagaagtttttgcccaggttaaacaaatctacaaaacaccacctattaaagattttggtggctttaacttttcacaaatattgccagatccatcaaaaccaagcaagaggtcatttattgaggatttactcttcaacaaagtgacacttgctgatgctggcttcatcaaacaatatggtgattgccttggtgatattgctgctagagatctcatctgtgcacaaaagttcaatggactcacggttctaccgcctttgctcacagatgaaatgattgctcaatacacttctgcactacttgctggaacaatcacctcaggttggacctttggtgcaggagctgctttacaaataccctttgcaatgcaaatggcttacaggtttaatggcattggagtcactcagaatgttctatatgagaatcagaaattaattgccaatcagttcaacagtgctattggcaaaatacaggattcactttcatctacggctagtgcacttggtaaacttcaagacgtcgtaaatcaaaatgcacaggctttaaacacacttgtcaaacaacttagttccaattttggagctatttcgagtgtgcttaatgatattctttcacgtcttgacaaagttgaggctgaagtgcaaattgataggttaatcacaggaagactacagagtcttcaaacttatgtgacacaacaattaatcagagcagcagaaatcagagcttctgctaatcttgctgcaacaaaaatgtctgagtgcgtactcggacaatctaaaagagttgatttttgtggaaaaggctaccatttaatgtctttccctcaatcagcaccgcatggtgttgttttcttgcatgttacttatgtacctgcacaagaaaagaactttactactgctcctgctatttgtcatgaaggaaaagcacacttccctcgtgaaggtgtcttcgtttcaaatggcactcattggtttattacacaaaggaatttttatgaacctcaaattattaccactgacaacacattcgtctctggtagctgtgatgttgtaattggaatagtcaacaacacagtttatgatcctttgcaacccgagcttgactcatttaaggaggagttagacaaatacttcaaaaatcacacatcaccagatgttgatcttggcgacatatctggcataaatgcttcggtcgtcaacatacaaaaagaaattgaccgcctcaatgaggttgccaaaaatttgaatgaatcactcattgacctacaagagcttggaaaatatgagcaatacatcaaatggccttggtacatttggcttggttttatagctgggctaattgctatcattatggtcacaatcatgctatgttgtatgactagttgctgtagttgcctcaagggttgttgctcttgcggttcctgctgcaaatttgatgaagacgattcagaacctgttctgaaaggagtcaaattacattacacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12743 - RNA, 4039 nt, synthetic construct; identical to SEQ ID NO: 162
  misc_feature 1..4039: note = SARS-CoV-2/Wuhan/WIV05/2019__EPI_ISL_402128 spike protein mRNA gc (1-1273) R9514
  source 1..4039: mol_type = other RNA

SEQ ID NO: 12744 - RNA, 4027 nt, synthetic construct
  misc_feature 1..4027: note = SARS-CoV-2/bat/Yunnan/RaTG13/2013__EPI_ISL_402131 spike protein mRNA gc (1-1269)
  source 1..4027: mol_type = other RNA
aggagaaagcttaccatgttcgtgttcctggtcctcctgcccctggtgagctcccagtgcgtgaacctcaccacccgcacgcagctgccgcccgcctacaccaacagctccacccggggcgtctactaccccgacaaggtgttccgcagctccgtgctgcacctcacccaggacctgttcctgcccttcttcagcaacgtcacgtggttccacgccatccacgtgtccgggaccaacggcatcaagcggttcgacaacccggtgctccccttcaacgacggggtctacttcgcgagcaccgagaagtccaacatcatccgcggctggatcttcgggaccacgctggacagcaagacccagtccctgctcatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcaccttcgagtacgtgagccagcccttcctgatggacctcgagggcaagcaggggaacttcaagaacctgcgcgagttcgtgttcaagaacatcgacggctacttcaagatctactccaagcacacgccgatcaacctggtccgggacctcccgcccgggttcagcgccctggagcccctggtggacctccccatcggcatcaacatcacccgcttccagaccctgctggccctccaccggtcctacctgacccccggggacagcagctccggctggacggcgggcgccgccgcctactacgtggggtacctgcagccccgcaccttcctcctgaagtacaacgagaacggcaccatcaccgacgcggtcgactgcgccctggaccccctcagcgagacgaagtgcaccctgaagtccttcaccgtggagaaggggatctaccagaccagcaacttccgggtgcagccgacggactccatcgtccgcttccccaacatcaccaacctgtgccccttcggcgaggtgttcaacgccaccaccttcgccagcgtctacgcctggaaccggaagcgcatctccaactgcgtggcggactacagcgtgctctacaactccacgagcttctccaccttcaagtgctacggcgtcagccccaccaagctgaacgacctgtgcttcaccaacgtgtacgccgactccttcgtgatcacgggggacgaggtccggcagatcgccccgggccagaccgggaagatcgccgactacaactacaagctccccgacgacttcaccggctgcgtgatcgcctggaacagcaagcacatcgacgcgaaggagggcgggaacttcaactacctgtaccgcctgttccggaaggccaacctcaagcccttcgagcgcgacatctccaccgagatctaccaggccggcagcaagccctgcaacgggcagacgggcctgaactgctactacccgctgtaccggtacgggttctaccccaccgacggcgtggggcaccagccctaccgcgtcgtggtgctctccttcgagctgctgaacgcccccgccaccgtctgcggcccgaagaagtccaccaacctcgtgaagaacaagtgcgtgaacttcaacttcaacggcctgaccgggacgggcgtcctgaccgagagcaacaagaagttcctgcccttccagcagttcgggcgggacatcgcggacaccaccgacgccgtgcgcgacccccagacgctcgagatcctggacatcaccccgtgcagcttcggcggggtgagcgtcatcacccccggcaccaacgcctccaaccaggtggccgtgctgtaccaggacgtcaactgcacggaggtgcccgtggccatccacgcggaccagctcacccccacctggcgcgtctacagcaccggctccaacgtgttccagacgcgggccgggtgcctgatcggcgccgagcacgtgaacaacagctacgagtgcgacatcccgatcggggccggcatctgcgcgtcctaccagacccagaccaacagccgctccgtcgccagccagtccatcatcgcctacaccatgagcctgggcgccgagaactccgtggcctacagcaacaactccatcgcgatccccacgaacttcaccatcagcgtgaccaccgagatcctccccgtctccatgacgaagaccagcgtggactgcaccatgtacatctgcggggactccaccgagtgcagcaacctgctgctccagtacggcagcttctgcacgcagctgaaccgggccctgaccgggatcgccgtggagcaggacaagaacacccaggaggtcttcgcccaggtgaagcagatctacaagacgcccccgatcaaggacttcggcgggttcaacttctcccagatcctccccgaccccagcaagccctccaagcgcagcttcatcgaggacctgctgttcaacaaggtgaccctcgccgacgcgggcttcatcaagcagtacggcgactgcctgggggacatcgccgcccgggacctgatctgcgcccagaagttcaacggcctcaccgtcctgccgcccctgctcaccgacgagatgatcgcccagtacacctccgcgctgctggccgggacgatcaccagcggctggaccttcggggccggcgccgcgctccagatccccttcgccatgcagatggcctaccgcttcaacggcatcggggtgacccagaacgtgctgtacgagaaccagaagctgatcgccaaccagttcaactccgccatcggcaagatccaggacagcctctccagcacggcgtccgccctggggaagctgcaggacgtcgtgaaccagaacgcccaggccctcaacaccctggtgaagcagctgagctccaacttcggcgccatcagctccgtcctcaacgacatcctgagccggctggacaaggtggaggcggaggtgcagatcgaccgcctcatcaccgggcggctgcagtccctgcagacctacgtcacccagcagctcatccgcgccgccgagatccgggccagcgccaacctggcggccacgaagatgtccgagtgcgtgctgggccagagcaagcgcgtggacttctgcggcaaggggtaccacctcatgagcttcccccagtccgccccgcacggcgtcgtgttcctgcacgtgacctacgtccccgcccaggagaagaacttcaccaccgcgcccgccatctgccacgacgggaaggcccacttcccccgggagggcgtgttcgtcagcaacgggacgcactggttcgtgacccagcgcaacttctacgagccgcagatcatcaccaccgacaacacgttcgtgtccggcagctgcgacgtcgtgatcggcatcgtgaacaacaccgtctacgaccccctgcagcccgagctcgactccttcaaggaggagctggacaagtacttcaagaaccacaccagccccgacgtggacctgggggacatctccggcatcaacgccagcgtggtcaacatccagaaggagatcgaccggctcaacgaggtggccaagaacctgaacgagtccctgatcgacctccaggagctggggaagtacgagcagtacatcaagtggccgtggtacatctggctgggcttcatcgcgggcctcatcgccatcatcatggtgaccatcatgctgtgctgcatgacgagctgctgctcctgcctgaaggggtgctgcagctgcggctcctgctgcaagttcgacgaggacgacagcgagcccgtcctcaagggggtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12745 - RNA, 4039 nt, synthetic construct
  misc_feature 1..4039: note = SARS-CoV-2/Wuhan/HBCDC-HB-01/2019__EPI_ISL_402132 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcatcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12746 - RNA, 4039 nt, synthetic construct
  misc_feature 1..4039: note = SARS-CoV-2/Guangdong/20SF028/2020__EPI_ISL_403936 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgtactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12747 - RNA, 4039 nt, synthetic construct
  misc_feature 1..4039: note = SARS-CoV-2/Shenzhen/SZTH-001/2020__EPI_ISL_406592 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtgctgatcggcatcgtcaacaacacggtgtacgaccccctgcagcccgagctcgactccttcaaggaggagctggacaagtacttcaagaaccacaccagccccgacgtggacctgggggacatctccggcatcaacgccagcgtcgtgaacatccagaaggagatcgaccgcctcaacgaggtggccaagaacctgaacgagtccctgatcgacctccaggagctggggaagtacgagcagtacatcaagtggccgtggtacatctggctgggcttcatcgccggcctcatcgcgatcgtcatggtgaccatcatgctgtgctgcatgaccagctgctgctcctgcctgaaggggtgctgcagctgcggctcctgctgcaagttcgacgaggacgacagcgggcccgtgctcaagggcgtcaagctgcactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12748 - RNA, 4039 nt, synthetic construct
  misc_feature 1..4039: note = SARS-CoV-2/Shenzhen/SZTH-004/2020__EPI_ISL_406595 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctgggaccgcaagcggatctccaactgcgtggcgtactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12749 - RNA, 4039 nt, synthetic construct
  misc_feature 1..4039: note = SARS-CoV-2/France/IDF0372/2020__EPI_ISL_406596 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcttcctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccaggacgtgaactgcaccgaggtgcccgtcgccatccacgccgaccagctgacgcccacctggcgggtgtactccaccggcagcaacgtgttccagacccgcgccgggtgcctcatcggcgcggagcacgtcaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtggcctactccaacaacagcatcgccatccccaccaacttcacgatctccgtcaccaccgagatcctgcccgtgagcatgaccaagacgagcgtggactgcaccatgtacatctgcggggactccaccgagtgcagcaacctcctgctgcagtacggctccttctgcacccagctcaaccgcgcgctgacggggatcgccgtcgagcaggacaagaacacccaggaggtgttcgcccaggtgaagcagatctacaagacgcccccgatcaaggacttcggcgggttcaacttcagccagatcctgcccgacccctccaagcccagcaagcggtccttcatcgaggacctcctgttcaacaaggtcaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtgacccagaacgtcctctacgagaaccagaagctgatcgccaaccagttcaacagcgccatcggcaagatccaggactccctgagctccaccgccagcgcgctcgggaagctgcaggacgtggtgaaccagaacgcccaggccctgaacacgctcgtcaagcagctgtccagcaacttcggcgccatctccagcgtgctgaacgacatcctctcccgcctggacaaggtggaggccgaggtccagatcgaccggctgatcaccgggcgcctccagagcctgcagacctacgtgacccagcagctgatccgggcggccgagatccgcgccagcgccaacctcgccgcgaccaagatgtccgagtgcgtgctgggccagagcaagcgggtcgacttctgcggcaaggggtaccacctgatgtccttcccccagagcgccccgcacggcgtggtgttcctccacgtcacgtacgtgcccgcccaggagaagaacttcaccaccgcccccgcgatctgccacgacgggaaggcccacttcccccgcgagggcgtcttcgtgtccaacgggacccactggttcgtgacgcagcggaacttctacgagccgcagatcatcaccaccgacaacaccttcgtcagcggcaactgcgacgtggtgatcggcatcgtcaacaacacggtgtacgaccccctgcagcccgagctggactccttcaaggaggagctcgacaagtacttcaagaaccacaccagccccgacgtggacctgggggacatctccggcatcaacgccagcgtcgtgaacatccagaaggagatcgaccgcctgaacgaggtggccaagaacctcaacgagtccctgatcgacctgcaggagctcgggaagtacgagcagtacatcaagtggccgtggtacatctggctgggcttcatcgccggcctgatcgcgatcgtcatggtgaccatcatgctctgctgcatgaccagctgctgctcctgcctgaaggggtgctgcagctgcggctcctgctgcaagttcgacgaggacgacagcgagcccgtgctgaagggggtcaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12750 - RNA, 4039 nt, synthetic construct
  misc_feature 1..4039: note = SARS-CoV-2/Australia/VIC01/2020__EPI_ISL_406844 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggcgctacctcacgccgggggactccagcagcggctggaccgcgggcgccgccgcctactacgtggggtacctgcagccccggaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgcgtgcagcccaccgagagcatcgtccggttcccgaacatcaccaacctgtgccccttcggcgaggtgttcaacgccacccgcttcgcctccgtctacgcctggaaccggaagcgcatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactacctgtaccggctgttccgcaagtccaacctcaagcccttcgagcgggacatcagcaccgagatctaccaggccggctccaccccctgcaacggggtggagggcttcaactgctacttccccctgcagagctacgggttccagccgaccaacggcgtggggtaccagccctaccgcgtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgggacccccagaccctggagatcctcgacatcaccccctgcagcttcggcggggtgagcgtgatcacgccgggcaccaacacctccaaccaggtcgccgtgctgtaccaggacgtgaactgcaccgaggtccccgtggccatccacgccgaccagctgacgcccacctggcgcgtgtacagcaccggctccaacgtcttccagacccgggccgggtgcctcatcggcgcggagcacgtgaacaacagctacgagtgcgacatccccatcggggccggcatctgcgcctcctaccagacgcagaccaacagcccgcgccgggcccgctccgtggcgagccagtccatcatcgcctacaccatgagcctgggcgccgagaactccgtcgcctacagcaacaactccatcgccatccccaccaacttcacgatcagcgtgaccaccgagatcctgcccgtgtccatgaccaagacgagcgtcgactgcaccatgtacatctgcggggacagcaccgagtgctccaacctcctgctgcagtacggcagcttctgcacccagctcaaccgggcgctgacggggatcgccgtggagcaggacaagaacacccaggaggtgttcgcccaggtcaagcagatctacaagacgcccccgatcaaggacttcggcgggttcaacttctcccagatcctgcccgaccccagcaagccctccaagcgcagcttcatcgaggacctcctgttcaacaaggtgaccctggccgacgccggcttcatcaagcagtacggcgactgcctcggggacatcgcggcccgggacctgatctgcgcccagaagttcaacggcctgaccgtgctcccgcccctgctgaccgacgagatgatcgcccagtacacctccgccctcctggcggggaccatcacgagcggctggaccttcggggccggcgccgccctgcagatccccttcgcgatgcagatggcctaccgcttcaacggcatcggggtcacccagaacgtgctctacgagaaccagaagctgatcgccaaccagttcaactccgccatcggcaagatccaggacagcctgtccagcaccgcctccgcgctcgggaagctgcaggacgtggtcaaccagaacgcccaggccctgaacacgctcgtgaagcagctgagctccaacttcggcgccatcagctccgtgctgaacgacatcctcagccggctggacaaggtcgaggccgaggtgcagatcgaccgcctgatcaccgggcggctccagtccctgcagacctacgtgacccagcagctgatccgcgcggccgagatccgggccagcgccaacctcgccgcgaccaagatgagcgagtgcgtcctgggccagtccaagcgcgtggacttctgcggcaaggggtaccacctgatgagcttcccccagtccgccccgcacggcgtggtcttcctccacgtgacgtacgtccccgcccaggagaagaacttcaccaccgcccccgcgatctgccacgacgggaaggcccacttcccccgggagggcgtgttcgtgagcaacgggacccactggttcgtcacgcagcgcaacttctacgagccgcagatcatcaccaccgacaacaccttcgtgtccggcaactgcgacgtggtcatcggcatcgtgaacaacacggtgtacgaccccctgcagcccgagctggacagcttcaaggaggagctcgacaagtacttcaagaaccacacctcccccgacgtcgacctgggggacatcagcggcatcaacgcctccgtggtgaacatccagaaggagatcgaccggctgaacgaggtcgccaagaacctcaacgagagcctgatcgacctgcaggagctcgggaagtacgagcagtacatcaagtggccgtggtacatctggctgggcttcatcgccggcctgatcgcgatcgtgatggtgaccatcatgctctgctgcatgacctcctgctgcagctgcctgaaggggtgctgctcctgcggcagctgctgcaagttcgacgaggacgactccgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12751 - RNA, 4039 nt, synthetic construct
  misc_feature 1..4039: note = SARS-CoV-2/Germany/BavPat1/2020__EPI_ISL_406862 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12752 - RNA, 4039 nt, synthetic construct
  misc_feature 1..4039: note = SARS-CoV-2/Wuhan/HBCDC-HB-02/2020__EPI_ISL_412978 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacttcctcctgcagtacggctccttctgcacccagctgaaccgcgcgctcacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctgggggacatcgcggcccgcgacctcatctgcgcccagaagttcaacggcctgaccgtgctgccgcccctcctgaccgacgagatgatcgcccagtacaccagcgccctgctcgcggggaccatcacgtccggctggaccttcggggccggcgccgccctgcagatccccttcgcgatgcagatggcctaccggttcaacggcatcggggtcacccagaacgtgctgtacgagaaccagaagctcatcgccaaccagttcaacagcgccatcggcaagatccaggactccctgagctccaccgccagcgcgctggggaagctccaggacgtggtcaaccagaacgcccaggccctgaacacgctggtgaagcagctctccagcaacttcggcgccatctccagcgtgctgaacgacatcctgtcccgcctcgacaaggtcgaggccgaggtgcagatcgaccggctgatcaccgggcgcctgcagagcctccagacctacgtgacccagcagctgatccgggcggccgagatccgcgccagcgccaacctggccgcgaccaagatgtccgagtgcgtcctcggccagagcaagcgggtggacttctgcggcaaggggtaccacctgatgtccttcccccagagcgccccgcacggcgtggtcttcctgcacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctccagcccgagctggactccttcaaggaggagctggacaagtacttcaagaaccacaccagccccgacgtcgacctcggggacatctccggcatcaacgccagcgtggtgaacatccagaaggagatcgaccgcctgaacgaggtcgccaagaacctgaacgagtccctcatcgacctgcaggagctggggaagtacgagcagtacatcaagtggccgtggtacatctggctcggcttcatcgccggcctgatcgcgatcgtgatggtgaccatcatgctgtgctgcatgaccagctgctgctcctgcctcaaggggtgctgcagctgcggctcctgctgcaagttcgacgaggacgacagcgagcccgtcctgaagggggtgaagctgcactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12753 - RNA, 4039 nt, synthetic construct
  misc_feature 1..4039: note = SARS-CoV-2/Australia/QLD02/2020__EPI_ISL_407896 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagctggagctcgactccttcaaggaggagctggacaagtacttcaagaaccacaccagccccgacgtcgacctgggggacatctccggcatcaacgccagcgtggtgaacatccagaaggagatcgaccgcctcaacgaggtcgccaagaacctgaacgagtccctgatcgacctccaggagctggggaagtacgagcagtacatcaagtggccctggtacatctggctgggcttcatcgccggcctcatcgcgatcgtgatggtgaccatcatgctgtgctgcatgaccagctgctgctcctgcctgaaggggtgctgcagctgcggctcctgctgcaagttcgacgaggacgacagcgagccggtcctcaagggggtgaagctgcactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12754 - RNA, 4039 nt, synthetic construct
  misc_feature 1..4039: note = SARS-CoV-2/India/1-31/2020__EPI_ISL_413523 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgtgatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccgcctggacaaggtggaggccgaggtgcagatcgaccggctgatcaccgggcgcctccagagcctgcagacctacgtcacccagcagctgatccgggccgcggagatccgcgccagcgccaacctcgccgccaccaagatgtccgagtgcgtgctgggccagagcaagcgggtggacttctgcggcaaggggtaccacctgatgtccttcccccagagcgcgccgcacggcgtcgtgttcctccacgtcacgtacgtgcccgcccaggagaagaacttcaccaccgcccccgccatctgccacgacgggaaggcgcacttcccccgcgagggcgtgttcgtctccaacgggacccactggttcgtgacgcagcggaacttctacgagccgcagatcatcaccaccgacaacaccttcgtgagcggcaactgcgacgtcgtgatcggcatcgtgaacaacacggtctacgaccccctgcagcccgagctggactccttcaaggaggagctcgacaagtacttcaagaaccacaccagccccgacgtggacctgggggacatctccggcatcaacgccagcgtggtcaacatccagaaggagatcgaccgcctgaacgaggtggccaagaacctcaacgagtccctgatcgacctgcaggagctcgggaagtacgagcagtacatcaagtggccgtggtacatctggctgggcttcatcgccggcctgatcgccatcgtgatggtcaccatcatgctctgctgcatgaccagctgctgctcctgcctgaaggggtgctgcagctgcggctcctgctgcaagttcgacgaggacgacagcgagcccgtgctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12755 - RNA, 4039 nt, synthetic construct
  misc_feature 1..4039: note SARS-CoV-2/Guangdong/GD2020087-P0008/2020__EPI_ISL_413863 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccgggagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12756 - RNA, 4039 nt, synthetic construct
  misc_feature 1..4039: note = SARS-CoV-2/Sweden/01/2020__EPI_ISL_411951 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggactgcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12757 - RNA, 4039 nt, synthetic construct
  misc_feature 1..4039: note = SARS-CoV-2/Tianmen/HBCDC-HB-07/2020__EPI_ISL_412983 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacctgaactgcaccgaggtgcccgtcgccatccacgccgaccagctcacgcccacctggcgggtgtactccaccggcagcaacgtgttccagacccgcgccgggtgcctgatcggcgcggagcacgtcaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtggcctactccaacaacagcatcgccatccccaccaacttcacgatctccgtcaccaccgagatcctccccgtgagcatgaccaagacgagcgtggactgcaccatgtacatctgcggggactccaccgagtgcagcaacctgctgctccagtacggctccttctgcacccagctgaaccgcgcgctgacggggatcgccgtcgagcaggacaagaacacccaggaggtgttcgcccaggtgaagcagatctacaagacgcccccgatcaaggacttcggcgggttcaacttcagccagatcctccccgacccctccaagcccagcaagcggtccttcatcgaggacctgctgttcaacaaggtcaccctcgccgacgccggcttcatcaagcagtacggcgactgcctgggggacatcgcggcccgcgacctgatctgcgcccagaagttcaacggcctcaccgtgctgccgcccctgctcaccgacgagatgatcgcccagtacaccagcgccctgctggcggggaccatcacgtccggctggaccttcggggccggcgccgccctccagatccccttcgcgatgcagatggcctaccggttcaacggcatcggggtgacccagaacgtcctgtacgagaaccagaagctgatcgccaaccagttcaacagcgccatcggcaagatccaggactccctcagctccaccgccagcgcgctggggaagctgcaggacgtggtgaaccagaacgcccaggccctcaacacgctggtcaagcagctgtccagcaacttcggcgccatctccagcgtgctcaacgacatcctgtcccgcctggacaaggtggaggccgaggtccagatcgaccggctcatcaccgggcgcctgcagagcctgcagacctacgtgacccagcagctcatccgggcggccgagatccgcgccagcgccaacctggccgcgaccaagatgtccgagtgcgtgctgggccagagcaagcgggtcgacttctgcggcaaggggtaccacctcatgtccttcccccagagcgccccgcacggcgtggtgttcctgcacgtcacgtacgtgcccgcccaggagaagaacttcaccaccgcccccgcgatctgccacgacgggaaggcccacttcccccgcgagggcgtcttcgtgtccaacgggacccactggttcgtgacgcagcggaacttctacgagccgcagatcatcaccaccgacaacaccttcgtcagcggcaactgcgacgtggtgatcggcatcgtcaacaacacggtgtacgaccccctgcagcccgagctcgactccttcaaggaggagctggacaagtacttcaagaaccacaccagccccgacgtggacctgggggacatctccggcatcaacgccagcgtcgtgaacatccagaaggagatcgaccgcctcaacgaggtggccaagaacctgaacgagtccctgatcgacctccaggagctggggaagtacgagcagtacatcaagtggccgtggtacatctggctgggcttcatcgccggcctcatcgcgatcgtcatggtgaccatcatgctgtgctgcatgaccagctgctgctcctgcctgaaggggtgctgcagctgcggctcctgctgcaagttcgacgaggacgacagcgagcccgtgctcaagggggtcaagctgcactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12758 - RNA, 4039 nt, synthetic construct
  misc_feature 1..4039: note = SARS-CoV-2/Hong Kong/case42_VM20002493/2020__EPI_ISL_414527 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcgcgatctccgtgacgaccgagatcctgcccgtgagcatgaccaagaccagcgtcgactgcacgatgtacatctgcggggactccaccgagtgcagcaacctcctgctgcagtacggctccttctgcacccagctcaaccgcgccctgaccgggatcgccgtggagcaggacaagaacacgcaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgcgggcttcatcaagcagtacggcgactgcctcggggacatcgccgcccgcgacctgatctgcgcccagaagttcaacggcctgaccgtgctcccgcccctgctgaccgacgagatgatcgcccagtacaccagcgcgctcctggccgggaccatcacctccggctggacgttcggggccggcgccgcgctgcagatccccttcgccatgcagatggcctaccggttcaacggcatcggggtcacccagaacgtgctctacgagaaccagaagctgatcgccaaccagttcaacagcgccatcggcaagatccaggactccctgagctccaccgcgagcgccctcgggaagctgcaggacgtggtcaaccagaacgcccaggccctgaacaccctcgtgaagcagctgtccagcaacttcggcgccatctccagcgtgctgaacgacatcctctcccgcctggacaaggtcgaggcggaggtgcagatcgaccggctgatcacggggcgcctccagagcctgcagacctacgtgacccagcagctgatccgggccgccgagatccgcgccagcgccaacctcgcggccaccaagatgtccgagtgcgtcctgggccagagcaagcgggtggacttctgcggcaaggggtaccacctgatgtccttcccccagagcgccccgcacggcgtggtcttcctccacgtgacctacgtccccgcccaggagaagaacttcacgaccgcgcccgccatctgccacgacgggaaggcccacttcccccgcgagggcgtgttcgtgtccaacgggacccactggttcgtcacccagcggaacttctacgagccgcagatcatcacgaccgacaacaccttcgtgagcggcaactgcgacgtggtcatcggcatcgtgaacaacaccgtgtacgaccccctgcagcccgagctggactccttcaaggaggagctcgacaagtacttcaagaaccacacgagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgcgggcctgatcgccatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12759 - RNA, 4039 nt, synthetic construct
  misc_feature 1..4039: note = SARS-CoV-2/USA/CruiseA-23/2020__EPI_ISL_414482 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggaggtgaagcagggcaacttcaagaacctccgcgagttcgtcttcaagaacatcgacgggtacttcaagatctactccaagcacaccccgatcaacctggtgcgggacctgccccagggcttcagcgccctcgagcccctggtggacctgcccatcgggatcaacatcacccgcttccagaccctcctggccctgcaccggtcctacctcacgccgggcgacagcagctccgggtggaccgcgggcgccgccgcctactacgtcggctacctgcagccccgcaccttcctgctcaagtacaacgagaacgggaccatcacggacgcggtggactgcgccctggaccccctgagcgagaccaagtgcaccctcaagtccttcaccgtggagaagggcatctaccagacgagcaacttccgggtccagcccaccgagtccatcgtgcgcttcccgaacatcaccaacctgtgccccttcggggaggtcttcaacgccacccggttcgccagcgtgtacgcctggaaccgcaagcggatctccaactgcgtggcggactacagcgtcctgtacaactccgccagcttctccacgttcaagtgctacggcgtgagccccaccaagctcaacgacctgtgcttcaccaacgtgtacgccgactccttcgtcatccgcggcgacgaggtgcggcagatcgcccccgggcagaccggcaagatcgccgactacaactacaagctgccggacgacttcacggggtgcgtgatcgcgtggaacagcaacaacctcgactccaaggtcggcgggaactacaactacctgtaccgcctgttccgcaagagcaacctcaagcccttcgagcgggacatctccaccgagatctaccaggccggcagcaccccctgcaacggcgtggaggggttcaactgctacttccccctgcagtcctacggcttccagccgaccaacggggtgggctaccagccctaccgggtcgtggtgctgagcttcgagctcctgcacgcccccgccacggtctgcgggcccaagaagtccaccaacctggtgaagaacaagtgcgtgaacttcaacttcaacggcctcaccggcaccggggtcctgaccgagagcaacaagaagttcctgccgttccagcagttcggccgcgacatcgccgacacgaccgacgcggtgcgcgacccccagaccctggagatcctcgacatcaccccctgcagcttcgggggcgtgtccgtcatcacgccggggaccaacaccagcaaccaggtggccgtgctgtaccaggacgtcaactgcaccgaggtgcccgtggccatccacgccgaccagctgacgcccacctggcgggtctactccaccggcagcaacgtgttccagacccgcgccggctgcctcatcggggcggagcacgtgaacaactcctacgagtgcgacatccccatcggcgccgggatctgcgccagctaccagacgcagaccaactccccgcggcgcgcccggagcgtcgcgtcccagagcatcatcgcctacaccatgtccctgggcgccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccgggttcatcaagcagtacggcgactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggggccgccctgcagatccccttcgcgatgcagatggcctaccggttcaacggcatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctggggcagagcaagcgggtggacttctgcggcaagggctaccacctgatgtccttcccccagagcgccccgcacggggtcgtgttcctccacgtcacgtacgtgcccgcccaggagaagaacttcaccaccgcccccgcgatctgccacgacggcaaggcccacttcccccgcgagggggtgttcgtctccaacggcacccactggttcgtgacgcagcggaacttctacgagccgcagatcatcaccaccgacaacaccttcgtgagcgggaactgcgacgtcgtgatcggcatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctggggttcatcgccggcctgatcgcgatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12760 - RNA, 4039 nt, synthetic construct
  misc_feature 1..4039: note = SARS-CoV-2/Hong Kong/case85_VM20002868/2020__EPI_ISL_414519 spike protein mRNA gc (1-1273)
  source 1..4039: mol_type = other RNA
aggagaaagcttaccatgttcgtgttcctggtcctcgtgcccctggtgagctcccagtgcgtcaacctgaccacccgcacgcagctcccgcccgcctacaccaacagcttcacccggggcgtgtactaccccgacaaggtgttccgctccagcgtcctgcactccacccaggacctgttcctccccttcttcagcaacgtgacgtggttccacgccatccacgtgtccgggaccaacggcaccaagcggttcgacaacccggtcctgcccttcaacgacggggtgtacttcgcgagcaccgagaagtccaacatcatccgcggctggatcttcgggacgaccctggacagcaagacccagtccctcctgatcgtgaacaacgccaccaacgtcgtgatcaaggtgtgcgagttccagttctgcaacgaccccttcctgggcgtctactaccacaagaacaacaagagctggatggagtccgagttccgggtgtacagctccgccaacaactgcacgttcgagtacgtgagccagcccttcctcatggacctggagggcaagcaggggaacttcaagaacctgcgcgagttcgtcttcaagaacatcgacggctacttcaagatctactccaagcacaccccgatcaacctcgtgcgggacctgccccaggggttcagcgccctggagcccctcgtggacctgcccatcggcatcaacatcacccgcttccagaccctgctcgccctgcaccggtcctacctgacgccgggggacagcagctccggctggaccgcgggcgccgccgcctactacgtcgggtacctccagccccgcaccttcctgctgaagtacaacgagaacggcaccatcacggacgcggtggactgcgccctcgaccccctgagcgagaccaagtgcaccctgaagtccttcaccgtggagaaggggatctaccagacgagcaacttccgggtccagcccaccgagtccatcgtgcgcttcccgaacatcaccaacctctgccccttcggcgaggtcttcaacgccacccggttcgccagcgtgtacgcctggaaccgcaagcggatctccaactgcgtggcggactacagcgtcctgtacaactccgccagcttctccacgttcaagtgctacggcgtgagccccaccaagctgaacgacctctgcttcaccaacgtgtacgccgactccttcgtcatccgcggggacgaggtgcggcagatcgcccccggccagaccgggaagatcgccgactacaactacaagctgccggacgacttcacgggctgcgtgatcgcgtggaacagcaacaacctggactccaaggtcgggggcaactacaactacctctaccgcctgttccgcaagagcaacctgaagcccttcgagcgggacatctccaccgagatctaccaggccggcagcaccccctgcaacggggtggagggcttcaactgctacttccccctccagtcctacgggttccagccgaccaacggcgtggggtaccagccctaccgggtcgtggtgctgagcttcgagctgctccacgcccccgccacggtctgcggccccaagaagtccaccaacctggtgaagaacaagtgcgtgaacttcaacttcaacggcctgaccgggaccggcgtcctcaccgagagcaacaagaagttcctgccgttccagcagttcgggcgcgacatcgccgacacgaccgacgcggtgcgcgacccccagaccctggagatcctggacatcaccccctgcagcttcggcggggtgtccgtcatcacgccgggcaccaacaccagcaaccaggtggccgtgctctaccaggacgtcaactgcaccgaggtgcccgtggccatccacgccgaccagctgacgcccacctggcgggtctactccaccggcagcaacgtgttccagacccgcgccgggtgcctgatcggcgcggagcacgtgaacaactcctacgagtgcgacatccccatcggggccggcatctgcgccagctaccagacgcagaccaactccccgcggcgcgcccggagcgtcgcgtcccagagcatcatcgcctacaccatgtccctcggcgccgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctgctcctgcagtacggctccttctgcacccagctgaaccgcgcgctcacggggatcgccgtggagcaggacaagaacacccaggaggtcttcgcccaggtgaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctgggggacatcgcggcccgcgacctcatctgcgcccagaagttcaacggcctgaccgtcctgccgcccctcctgaccgacgagatgatcgcccagtacaccagcgccctgctcgcggggaccatcacgtccggctggaccttcggggccggcgccgccctgcagatccccttcgcgatgcagatggcctaccggttcaacggcatcggggtgacccagaacgtgctgtacgagaaccagaagctcatcgccaaccagttcaacagcgccatcggcaagatccaggactccctgagctccaccgccagcgcgctggggaagctccaggacgtcgtgaaccagaacgcccaggccctgaacacgctggtgaagcagctctccagcaacttcggcgccatctccagcgtcctgaacgacatcctgtcccgcctcgacaaggtggaggccgaggtgcagatcgaccggctgatcaccgggcgcctgcagagcctccagacctacgtcacccagcagctgatccgggcggccgagatccgcgccagcgccaacctggccgcgaccaagatgtccgagtgcgtgctcggccagagcaagcgggtggacttctgcggcaaggggtaccacctgatgtccttcccccagagcgccccgcacggcgtcgtgttcctgcacgtcacgtacgtgcccgcccaggagaagaacttcaccaccgcccccgcgatctgccacgacgggaaggcccacttcccccgcgagggcgtgttcgtctccaacgggacccactggttcgtgacgcagcggaacttctacgagccgcagatcatcaccaccgacaacaccttcgtgagcggcaactgcgacgtcgtgatcggcatcgtgaacaacacggtctacgaccccctccagcccgagctggactccttcaaggaggagctggacaagtacttcaagaaccacaccagccccgacgtggacctcggggacatctccggcatcaacgccagcgtggtcaacatccagaaggagatcgaccgcctgaacgaggtggccaagaacctgaacgagtccctcatcgacctgcaggagctggggaagtacgagcagtacatcaagtggccgtggtacatctggctcggcttcatcgccggcctgatcgcgatcgtgatggtcaccatcatgctgtgctgcatgaccagctgctgctcctgcctcaaggggtgctgcagctgcggctcctgctgcaagttcgacgaggacgacagcgagcccgtgctgaagggggtgaagctgcactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12761 - RNA, 4039 nt, synthetic construct
  misc_feature 1..4039: note = SARS-CoV-2/England/200990660/2020__EPI_ISL_414523 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagctggtcctcaagggcgtgaagctgcactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12762 - RNA, 4039 nt, synthetic construct
  misc_feature 1..4039: note = SARS-CoV-2/Australia/NSW09/2020__EPI_ISL_413595 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagcttcaccgcctccgcgctcgggaagctgcaggacgtggtcaaccagaacgcccaggccctgaacacgctcgtgaagcagctgagctccaacttcggcgccatcagctccgtgctgaacgacatcctcagccgcctggacaaggtcgaggccgaggtgcagatcgaccggctgatcaccgggcgcctccagtccctgcagacctacgtgacccagcagctgatccgggcggccgagatccgcgccagcgccaacctcgccgcgaccaagatgagcgagtgcgtcctgggccagtccaagcgggtggacttctgcggcaaggggtaccacctgatgagcttcccccagtccgccccgcacggcgtggtcttcctccacgtgacgtacgtccccgcccaggagaagaacttcaccaccgcccccgcgatctgccacgacgggaaggcccacttcccccgcgagggcgtgttcgtgagcaacgggacccactggttcgtcacgcagcggaacttctacgagccgcagatcatcaccaccgacaacaccttcgtgtccggcaactgcgacgtggtcatcggcatcgtgaacaacacggtgtacgaccccctgcagcccgagctggacagcttcaaggaggagctcgacaagtacttcaagaaccacacctcccccgacgtcgacctgggggacatcagcggcatcaacgcctccgtggtgaacatccagaaggagatcgaccgcctgaacgaggtcgccaagaacctcaacgagagcctgatcgacctgcaggagctcgggaagtacgagcagtacatcaagtggccgtggtacatctggctgggcttcatcgccggcctgatcgcgatcgtgatggtgaccatcatgctctgctgcatgacctcctgctgcagctgcctgaaggggtgctgctcctgcggcagctgctgcaagttcgacgaggacgactccgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12763 - RNA, 4039 nt, synthetic construct
  misc_feature 1..4039: note = SARS-CoV-2/Australia/NSW10/2020__EPI_ISL_413596 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgcttcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12764 - RNA, 4039 nt, synthetic construct
  misc_feature 1..4039: note SARS-CoV-2/Switzerland/1000477797/2020__EPI_ISL_413023 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaacatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12765 - RNA, 4039 nt, synthetic construct
  misc_feature 1..4039: note = SARS-CoV-2/Belgium/BA-02291/2020__EPI_ISL_415159 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccggcgcagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgcgtggtcgtgctgagcttcgagctcctgcccgcccccgccacggtgtgcggcccgaagaagtccaccaacctggtcaagaacaagtgcgtgaacttcaacttcaacggcctcaccgggaccggcgtgctgaccgagtccaacaagaagttcctgcccttccagcagttcgggcgcgacatcgccgacacgaccgacgcggtccgggacccccagaccctggagatcctcgacatcaccccgtgcagcttcggcggggtgtccgtgatcacgcccggcaccaacaccagcaaccaggtcgccgtgctgtaccagggcgtgaactgcaccgaggtccccgtggccatccacgccgaccagctgacgcccacctggcgcgtgtactccaccgggagcaacgtcttccagacccgggccggctgcctcatcggggcggagcacgtgaacaactcctacgagtgcgacatcccgatcggcgccggcatctgcgccagctaccagacgcagaccaacagcccccgccgggcccgcagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgggcgctgacgggcatcgccgtggagcaggacaagaacacccaggaggtgttcgcccaggtcaagcagatctacaagaccccgcccatcaaggacttcgggggcttcaacttcagccagatcctgcccgacccctccaagccgagcaagcgctccttcatcgaggacctcctgttcaacaaggtgaccctggccgacgccggcttcatcaagcagtacggggactgcctcggcgacatcgcggcccgggacctgatctgcgcccagaagttcaacgggctgacggtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccgcttcaacgggatcggcgtcacccagaacgtgctctacgagaaccagaagctgatcgccaaccagttcaacagcgccatcgggaagatccaggactccctgagctccgccgcgcccgccctcggcaagctgcaggacgtggtcaaccagaacgcccaggccctgaacaccctcgtgaagcagctgagctccaacttcggggccatcagctccgtgctgaacgacatcctcagccggctggacaaggtcgaggcggaggtgcagatcgaccgcctgatcacgggccggctccagtccctgcagacctacgtgacccagcagctgatccgcgccgccgagatccgggccagcgccaacctcgcggccaccaagatgagcgagtgcgtcctgggccagtccaagcgcgtggacttctgcgggaagggctaccacctgatgagcttcccccagtccgcgccccacggggtggtcttcctccacgtgacctacgtccccgcccaggagaagaacttcacgaccgccccggccatctgccacgacggcaaggcccacttcccccgggagggggtgttcgtgagcaacggcacccactggttcgtcacccagcgcaacttctacgagccccagatcatcacgaccgacaacaccttcgtgtccggcaactgcgacgtggtcatcgggatcgtgaacaacaccgtgtacgaccccctgcagccggagctggacagcttcaaggaggagctcgacaagtacttcaagaaccacacgtcccccgacgtcgacctgggcgacatcagcgggatcaacgcctccgtggtgaacatccagaaggagatcgaccggctgaacgaggtcgccaagaacctcaacgagagcctgatcgacctgcaggagctcggcaagtacgagcagtacatcaagtggccctggtacatctggctgggcttcatcgcggggctgatcgccatcgtgatggtgaccatcatgctctgctgcatgacctcctgctgcagctgcctgaagggctgctgctcctgcgggagctgctgcaagttcgacgaggacgactccgagccggtcctgaagggcgtgaagctccactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12766 - RNA, 4039 nt, synthetic construct
  misc_feature 1..4039: note = SARS-CoV-2/USA/WA8-UW5/2020__EPI_ISL_413486 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12767 - RNA, 4039 nt, synthetic construct
  misc_feature 1..4039: note = SARS-CoV-2/England/20102000506/2020__EPI_ISL_415147 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacgggtactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12768 - RNA, 4039 nt, synthetic construct
  misc_feature 1..4039: note = SARS-CoV-2/Belgium/VAG-03013/2020__EPI_ISL_415155 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccacggcgctcggcaagctgcaggacgtggtcaaccagaacgcccaggccctgaacaccctcgtgaagcagctgagctccaacttcggggccatcagctccgtgctgaacgacatcctcagccgcctggacaaggtcgaggccgaggtgcagatcgaccggctgatcaccggccgcctccagtccctgcagacctacgtgacccagcagctgatccgggcggccgagatccgcgccagcgccaacctcgccgcgacgaagatgagcgagtgcgtcctgggccagtccaagcgggtggacttctgcgggaagggctaccacctgatgagcttcccccagtccgccccgcacggggtggtcttcctccacgtgacctacgtccccgcccaggagaagaacttcaccaccgcccccgcgatctgccacgacggcaaggcccacttcccccgcgagggggtgttcgtgagcaacggcacgcactggttcgtcacccagcggaacttctacgagccgcagatcatcaccaccgacaacacgttcgtgtccggcaactgcgacgtggtcatcgggatcgtgaacaacaccgtgtacgaccccctgcagcccgagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccgtggtacatctggctgggcttcatcgccgggctgatcgcgatcgtgatggtgaccatcatgctctgctgcatgacgtcctgctgcagctgcctgaagggctgctgctcctgcgggagctgctgcaagttcgacgaggacgactccgagcccgtcctgaagggcgtgaagctccactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12769 - RNA, 4039 nt, synthetic construct
  misc_feature 1..4039: note = SARS-CoV-2/Belgium/BC-03016/2020__EPI_ISL_415157 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgcccccgcgctcggcaagctgcaggacgtggtcaaccagaacgcccaggccctgaacacgctcgtgaagcagctgagctccaacttcggggccatcagctccgtgctgaacgacatcctcagccgcctggacaaggtcgaggccgaggtgcagatcgaccggctgatcaccggccgcctccagtccctgcagacctacgtgacccagcagctgatccgggcggccgagatccgcgccagcgccaacctcgccgcgaccaagatgagcgagtgcgtcctgggccagtccaagcgggtggacttctgcgggaagggctaccacctgatgagcttcccgcagtccgcgccccacggggtggtcttcctccacgtgacgtacgtccccgcccaggagaagaacttcaccaccgcccccgccatctgccacgacggcaaggcccacttcccgcgcgagggggtgttcgtgagcaacggcacccactggttcgtcacgcagcggaacttctacgagccccagatcatcaccaccgacaacaccttcgtgtccggcaactgcgacgtggtcatcgggatcgtgaacaacacggtgtacgaccccctgcagcccgagctggacagcttcaaggaggagctcgacaagtacttcaagaaccacacctccccggacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccctggtacatctggctgggcttcatcgccgggctgatcgcgatcgtgatggtgaccatcatgctctgctgcatgacctcctgctgcagctgcctgaagggctgctgctcctgcgggagctgctgcaagttcgacgaggacgactccgagcccgtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12770 - RNA, 4039 nt, synthetic construct
  misc_feature 1..4039: note = SARS-CoV-2/Germany/BavPat3/2020__EPI_ISL_414521 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccagcaggtcttcgcccaggtgaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12771 - RNA, 4039 nt, synthetic construct
  misc_feature 1..4039: note = SARS-CoV-2/France/HF1805/2020__EPI_ISL_414628 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcggggtggtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12772 - RNA, 4039 nt, synthetic construct
  misc_feature 1..4039: note SARS-CoV-2/Netherlands/ZuidHolland_9/2020__EPI_ISL_414445 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgtgcagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggccgcggagatccgcgccagcgccaacctcgccgccaccaagatgtccgagtgcgtgctgggccagagcaagcgggtggacttctgcgggaagggctaccacctgatgtccttcccccagagcgcgccgcacggggtcgtgttcctccacgtcacgtacgtgcccgcccaggagaagaacttcaccaccgcccccgccatctgccacgacggcaaggcgcacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgccatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12773 - RNA, 4039 nt, synthetic construct
  misc_feature 1..4039: note = SARS-CoV-2/Finland/FIN03032020A/2020__EPI_ISL_413602 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcagctggaactccaacaacctcgacagcaaggtcgggggcaactacaactacctgtaccgcctgttccggaagtccaacctcaagcccttcgagcgcgacatcagcaccgagatctaccaggcgggctccaccccctgcaacggggtggagggcttcaactgctacttccccctgcagagctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgctccttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccatcatcgcgtacaccatgagcctgggggccgagaactccgtcgcctacagcaacaactccatcgccatccccaccaacttcacgatcagcgtgaccaccgagatcctgcccgtgagcatgaccaagacgtccgtcgactgcaccatgtacatctgcggcgacagcaccgagtgctccaacctcctgctgcagtacgggagcttctgcacccagctcaaccgcgccctgacgggcatcgcggtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtgctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtcacccagaacgtgctctacgagaaccagaagctgatcgccaaccagttcaactccgccatcgggaagatccaggacagcctgtccagcaccgcctccgccctcggcaagctgcaggacgtggtcaaccagaacgcgcaggccctgaacacgctcgtgaagcagctgagctccaacttcggggccatcagctccgtgctgaacgacatcctcagccgcctggacaaggtcgaggccgaggtgcagatcgaccggctgatcaccggccgcctccagagcctgcagacctacgtgacccagcagctgatccgggccgcggagatccgcgcctccgccaacctcgccgccaccaagatgagcgagtgcgtcctgggccagtccaagcgggtggacttctgcgggaagggctaccacctgatgagcttcccccagtccgcgccgcacggggtggtcttcctccacgtgacgtacgtccccgcccaggagaagaacttcaccaccgcccccgccatctgccacgacggcaaggcgcacttcccccgcgagggggtgttcgtgagcaacggcacccactggttcgtcacgcagcggaacttctacgagccgcagatcatcaccaccgacaacaccttcgtgtccggcaactgcgacgtggtcatcgggatcgtgaacaacacggtgtacgaccccctgcagcccgagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccgtggtacatctggctgggcttcatcgccgggctgatcgccatcgtgatggtgaccatcatgctctgctgcatgacctcctgctgcagctgcctgaagggctgctgctcctgcgggagctgctgcaagttcgacgaggacgactccgagcccgtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12774 - RNA, 4039 nt, synthetic construct
  misc_feature 1..4039: note = SARS-CoV-2/France/GE1977/2020__EPI_ISL_414632 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgttcagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacaaggtcgaggccgaggtgcagatcgaccggctgatcaccggccgcctccagtccctgcagacctacgtgacccagcagctgatccgggcggccgagatccgcgccagcgccaacctcgccgcgaccaagatgagcgagtgcgtcctgggccagtccaagcgggtggacttctgcgggaagggctaccacctgatgagcttcccccagtccgccccgcacggggtggtcttcctccacgtgacgtacgtccccgcccaggagaagaacttcaccaccgcccccgcgatctgccacgacggcaaggcccacttcccccgcgagggggtgttcgtgagcaacggcacccactggttcgtcacgcagcggaacttctacgagccgcagatcatcaccaccgacaacaccttcgtgtccggcaactgcgacgtggtcatcgggatcgtgaacaacacggtgtacgaccccctgcagcccgagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccgtggtacatctggctgggcttcatcgccgggctgatcgcgatcgtgatggtgaccatcatgctctgctgcatgacctcctgctgcagctgcctgaagggctgctgctcctgcgggagctgctgcaagttcgacgaggacgactccgagcccgtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12775 - RNA, 4039 nt, synthetic construct
  misc_feature 1..4039: note = SARS-CoV-2/Finland/FIN-313/2020__EPI_ISL_414641 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttcaagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12776 - RNA, 4039 nt, synthetic construct
  misc_feature 1..4039: note SARS-CoV-2/Netherlands/ZuidHolland_2/2020__EPI_ISL_414556 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccctggagcaggacaagaacacccaggaggtgttcgcccaggtgaagcagatctacaagacgcccccgatcaaggacttcgggggcttcaacttcagccagatcctccccgacccctccaagcccagcaagcggtccttcatcgaggacctgctgttcaacaaggtcaccctcgccgacgccggcttcatcaagcagtacggggactgcctgggcgacatcgcggcccgcgacctgatctgcgcccagaagttcaacgggctcaccgtgctgccgcccctgctcaccgacgagatgatcgcccagtacaccagcgccctgctggcgggcaccatcacgtccgggtggaccttcggcgccggcgccgccctccagatccccttcgcgatgcagatggcctaccggttcaacgggatcggcgtgacccagaacgtcctgtacgagaaccagaagctgatcgccaaccagttcaacagcgccatcgggaagatccaggactccctcagctccaccgccagcgcgctgggcaagctgcaggacgtggtgaaccagaacgcccaggccctcaacacgctggtcaagcagctgtccagcaacttcggggccatctccagcgtgctcaacgacatcctgtcccgcctggacaaggtggaggccgaggtccagatcgaccggctcatcaccggccgcctgcagagcctgcagacctacgtgacccagcagctcatccgggcggccgagatccgcgccagcgccaacctggccgcgaccaagatgtccgagtgcgtgctgggccagagcaagcgggtcgacttctgcgggaagggctaccacctcatgtccttcccccagagcgccccgcacggggtggtgttcctgcacgtcacgtacgtgcccgcccaggagaagaacttcaccaccgcccccgcgatctgccacgacggcaaggcccacttcccccgcgagggggtcttcgtgtccaacggcacccactggttcgtgacgcagcggaacttctacgagccgcagatcatcaccaccgacaacaccttcgtcagcggcaactgcgacgtggtgatcgggatcgtcaacaacacggtgtacgaccccctgcagcccgagctcgactccttcaaggaggagctggacaagtacttcaagaaccacaccagccccgacgtggacctgggcgacatctccgggatcaacgccagcgtcgtgaacatccagaaggagatcgaccgcctcaacgaggtggccaagaacctgaacgagtccctgatcgacctccaggagctgggcaagtacgagcagtacatcaagtggccgtggtacatctggctgggcttcatcgccgggctcatcgcgatcgtcatggtgaccatcatgctgtgctgcatgaccagctgctgctcctgcctgaagggctgctgcagctgcgggtcctgctgcaagttcgacgaggacgacagcgagcccgtgctcaagggcgtcaagctgcactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12777 - RNA, 4039 nt, synthetic construct
  misc_feature 1..4039: note = SARS-CoV-2/USA/WA-UW31/2020__EPI_ISL_414618 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggccgagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgcggacacgaccgacgccgtgcgcgacccccagaccctggagatcctcgacatcaccccctgcagcttcggcggggtctccgtgatcacgccgggcaccaacaccagcaaccaggtggccgtcctgtaccaggacgtgaactgcaccgaggtgcccgtcgccatccacgccgaccagctgacgcccacctggcgggtgtactccaccggcagcaacgtgttccagacccgcgcggggtgcctcatcggcgccgagcacgtcaacaactcctacgagtgcgacatccccatcggggccggcatctgcgccagctaccagacgcagaccaactccccgcggcgcgcgcggagcgtggcctcccagagcatcatcgcctacaccatgtccctgggcgccgagaacagcgtggcctactccaacaacagcatcgcgatccccaccaacttcacgatctccgtcaccaccgagatcctgcccgtgagcatgaccaagacgagcgtggactgcaccatgtacatctgcggggactccaccgagtgcagcaacctcctgctgcagtacggctccttctgcacccagctcaaccgcgccctgacggggatcgccgtcgagcaggacaagaacacccaggaggtgttcgcccaggtgaagcagatctacaagacgcccccgatcaaggacttcggcgggttcaacttcagccagatcctgcccgacccctccaagcccagcaagcggtccttcatcgaggacctcctgttcaacaaggtcaccctggccgacgcgggcttcatcaagcagtacggcgactgcctcggggacatcgccgcccgcgacctgatctgcgcccagaagttcaacggcctgaccgtgctcccgcccctgctgaccgacgagatgatcgcccagtacaccagcgcgctcctggccgggaccatcacgtccggctggaccttcggggccggcgccgcgctgcagatccccttcgccatgcagatggcctaccggttcaacggcatcggggtgacccagaacgtcctctacgagaaccagaagctgatcgccaaccagttcaacagcgccatcggcaagatccaggactccctgagctccaccgcgagcgccctcgggaagctgcaggacgtggtgaaccagaacgcccaggccctgaacacgctcgtcaagcagctgtccagcaacttcggcgccatctccagcgtgctgaacgacatcctctcccgcctggacaaggtggaggcggaggtccagatcgaccggctgatcaccgggcgcctccagagcctgcagacctacgtgacccagcagctgatccgggccgccgagatccgcgccagcgccaacctcgcggccaccaagatgtccgagtgcgtgctgggccagagcaagcgggtcgacttctgcggcaaggggtaccacctgatgtccttcccccagagcgccccgcacggcgtggtgttcctccacgtcacgtacgtgcccgcccaggagaagaacttcaccaccgcgcccgccatctgccacgacgggaaggcccacttcccccgcgagggcgtcttcgtgtccaacgggacccactggttcgtgacgcagcggaacttctacgagccgcagatcatcaccaccgacaacaccttcgtcagcggcaactgcgacgtggtgatcggcatcgtcaacaacacggtgtacgaccccctgcagcccgagctggactccttcaaggaggagctcgacaagtacttcaagaaccacaccagccccgacgtggacctgggggacatctccggcatcaacgccagcgtcgtgaacatccagaaggagatcgaccgcctgaacgaggtggccaagaacctcaacgagtccctgatcgacctgcaggagctcgggaagtacgagcagtacatcaagtggccgtggtacatctggctgggcttcatcgcgggcctgatcgccatcgtcatggtgaccatcatgctctgctgcatgaccagctgctgctcctgcctgaaggggtgctgcagctgcggctcctgctgcaagttcgacgaggacgacagcgagcccgtgctgaagggggtcaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12778 - RNA, 4039 nt, synthetic construct
  misc_feature 1..4039: note = SARS-CoV-2/South Korea/SNU01/2020__EPI_ISL_411929 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttctgggccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactacctgtaccgcctgttccggaagtccaacctcaagcccttcgagcgcgacatcagcaccgagatctaccaggccggctccaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccaggacgtgaactgcaccgaggtccccgtggccatccacgccgaccagctgacgcccacctggcgggtgtacagcaccggctccaacgtcttccagacccgcgccgggtgcctcatcggcgcggagcacgtgaacaacagctacgagtgcgacatccccatcggggccggcatctgcgcctcctaccagacgcagaccaacagcccgcggcgcgcccggtccgtggcgagccagtccatcatcgcctacaccatgagcctgggcgccgagaactccgtcgcctacagcaacaactccatcgccatccccaccaacttcacgatcagcgtgaccaccgagatcctgcccgtgtccatgaccaagacgagcgtcgactgcaccatgtacatctgcggggacagcaccgagtgctccaacctcctgctgcagtacggcagcttctgcacccagctcaaccgcgcgctgacggggatcgccgtggagcaggacaagaacacccaggaggtgttcgcccaggtcaagcagatctacaagacgcccccgatcaaggacttcggcgggttcaacttctcccagatcctgcccgaccccagcaagccctccaagcggagcttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacacctccgccctcctggcggggaccatcacgagcggctggaccttcggggccggcgccgccctgcagatccccttcgcgatgcagatggcctaccggttcaacggcatcggggtcacccagaacgtgctctacgagaaccagaagctgatcgccaaccagttcaactccgccatcggcaagatccaggacagcctgtccagcaccgcctccgcgctcgggaagctgcaggacgtggtcaaccagaacgcccaggccctgaacacgctcgtgaagcagctgagctccaacttcggcgccatcagctccgtgctgaacgacatcctcagccgcctggacaaggtcgaggccgaggtgcagatcgaccggctgatcaccgggcgcctccagtccctgcagacctacgtgacccagcagctgatccgggcggccgagatccgcgccagcgccaacctcgccgcgaccaagatgagcgagtgcgtcctgggccagtccaagcgggtggacttctgcggcaaggggtaccacctgatgagcttcccccagtccgccccgcacggcgtggtcttcctccacgtgacgtacgtccccgcccaggagaagaacttcaccaccgcccccgcgatctgccacgacgggaaggcccacttcccccgcgagggcgtgttcgtgagcaacgggacccactggttcgtcacgcagcggaacttctacgagccgcagatcatcaccaccgacaacaccttcgtgtccggcaactgcgacgtggtcatcggcatcgtgaacaacacggtgtacgaccccctgcagcccgagctggacagcttcaaggaggagctcgacaagtacttcaagaaccacacctcccccgacgtcgacctgggggacatcagcggcatcaacgcctccgtggtgaacatccagaaggagatcgaccgcctgaacgaggtcgccaagaacctcaacgagagcctgatcgacctgcaggagctcgggaagtacgagcagtacatcaagtggccgtggtacatctggctgggcttcatcgccggcctgatcgcgatcgtgatggtgaccatcatgctctgctgcatgacctcctgctgcagctgcctgaaggggtgctgctcctgcggcagctgctgcaagttcgacgaggacgactccgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12779 - RNA, 4039 nt, synthetic construct
  misc_feature 1..4039: note = SARS-CoV-2/China/WF0004/2020__EPI_ISL_413694 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggacggagtccgagttccgggtctacagctccgccaacaactgcaccttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagacgctcctggccctgcaccggtcctacctcaccccgggggacagcagctccggctggaccgcgggcgccgccgcctactacgtggggtacctgcagccccgcaccttcctgctcaagtacaacgagaacggcacgatcaccgacgcggtcgactgcgccctggaccccctgagcgagaccaagtgcaccctcaagtccttcacggtggagaaggggatctaccagaccagcaacttccgggtgcagcccaccgagtccatcgtccgcttcccgaacatcaccaacctgtgccccttcggcgaggtgttcaacgccacgcggttcgccagcgtctacgcctggaaccgcaagcggatctccaactgcgtggcggactacagcgtgctgtacaactccgccagcttctccaccttcaagtgctacggcgtcagccccaccaagctcaacgacctgtgcttcaccaacgtgtacgccgactccttcgtgatccgcggggacgaggtccggcagatcgcccccggccagacggggaagatcgccgactacaactacaagctgccggacgacttcaccggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacgaacggcgtggggtaccagccctaccgggtggtcgtgctgagcttcgagctcctgcacgcccccgccaccgtgtgcggccccaagaagtccaccaacctggtcaagaacaagtgcgtgaacttcaacttcaacggcctcaccgggaccggcgtgctgacggagagcaacaagaagttcctgccgttccagcagttcgggcgcgacatcgccgacaccaccgacgcggtccgcgacccccagaccctggagatcctcgacatcacgccctgcagcttcggcggggtgtccgtgatcaccccgggcaccaacaccagcaaccaggtcgccgtgctgtaccaggacgtgaactgcacggaggtccccgtggccatccacgccgaccagctgacccccacctggcgggtgtactccaccggcagcaacgtcttccagacgcgcgccgggtgcctcatcggcgcggagcacgtgaacaactcctacgagtgcgacatccccatcggggccggcatctgcgccagctaccagacccagaccaactccccgcggcgcgcccggagcgtggcgtcccagagcatcatcgcctacaccatgtccctgggcgccgagaacagcgtcgcctactccaacaacagcatcgccatccccacgaacttcaccatctccgtgaccaccgagatcctgcccgtgagcatgacgaagaccagcgtcgactgcaccatgtacatctgcggggactccaccgagtgcagcaacctcctgctgcagtacggctccttctgcacgcagctcaaccgcgcgctgaccgggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggacgatcacctccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccacggccagcgcgctcgggaagctgcaggacgtggtcaaccagaacgcccaggccctgaacaccctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgacgaagatgtccgagtgcgtcctgggccagagcaagcggttcgacttctgcggcaaggggtaccacctgatgtccttcccccagagcgccccgcacggcgtggtgttcctccacgtcacctacgtgcccgcccaggagaagaacttcaccaccgcccccgcgatctgccacgacgggaaggcccacttcccccgcgagggcgtcttcgtgtccaacgggacgcactggttcgtgacccagcggaacttctacgagccgcagatcatcaccaccgacaacacgttcgtcagcggcaactgcgacgtggtgatcggcatcgtcaacaacaccgtgtacgaccccctgcagcccgagctggactccttcaaggaggagctcgacaagtacttcaagaaccacaccagccccgacgtggacctgggggacatctccggcatcaacgccagcgtcgtgaacatccagaaggagatcgaccgcctgaacgaggtggccaagaacctcaacgagtccctgatcgacctgcaggagctcgggaagtacgagcagtacatcaagtggccgtggtacatctggctgggcttcatcgccggcctgatcgcgatcgtcatggtgaccatcatgctctgctgcatgacgagctgctgctcctgcctgaaggggtgctgcagctgcggctcctgctgcaagttcgacgaggacgacagcgagcccgtgctgaagggggtcaagctccactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12780 - RNA, 4039 nt, synthetic construct
  misc_feature 1..4039: note = SARS-CoV-2/China/WF0028/2020__EPI_ISL_413791 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggagtccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12781 - RNA, 4039 nt, synthetic construct
  misc_feature 1..4039: note = SARS-CoV-2/2019-nCoV/USA-CruiseA-18/2020__MT159716.1 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagctgcgggtctacagctccgccaacaactgcacgttcgagtacgtgagccagcccttcctgatggacctcgagggcaagcaggggaacttcaagaacctgcgcgagttcgtgttcaagaacatcgacggctacttcaagatctactccaagcacaccccgatcaacctggtccgggacctcccccaggggttcagcgccctggagcccctggtggacctccccatcggcatcaacatcacccgcttccagaccctgctggccctccaccggtcctacctgacgccgggggacagcagctccggctggaccgcgggcgccgccgcctactacgtggggtacctgcagccccgcaccttcctcctgaagtacaacgagaacggcaccatcacggacgcggtcgactgcgccctggaccccctcagcgagaccaagtgcaccctgaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctctacaactccgccagcttctccacgttcaagtgctacggcgtcagccccaccaagctgaacgacctgtgcttcaccaacgtgtacgccgactccttcgtgatccgcggggacgaggtccggcagatcgcccccggccagaccgggaagatcgccgactacaactacaagctcccggacgacttcacgggctgcgtgatcgcgtggaacagcaacaacctggactccaaggtcgggggcaactacaactacctgtaccgcctcttccgcaagagcaacctgaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctcagcttcgagctgctgcacgcccccgccacggtgtgcggccccaagaagtccaccaacctcgtcaagaacaagtgcgtgaacttcaacttcaacggcctgaccgggaccggcgtgctgaccgagagcaacaagaagttcctgccgttccagcagttcgggcgcgacatcgccgacacgaccgacgcggtccgcgacccccagaccctcgagatcctggacatcaccccctgcagcttcggcggggtgtccgtgatcacgccgggcaccaacaccagcaaccaggtcgccgtgctgtaccaggacgtgaactgcaccgaggtccccgtggccatccacgccgaccagctcacgcccacctggcgggtgtactccaccggcagcaacgtcttccagacccgcgccgggtgcctgatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctccccgtgagcatgaccaagacgagcgtcgactgcaccatgtacatctgcggggactccaccgagtgcagcaacctgctgctccagtacggctccttctgcacccagctgaaccgcgcgctgacggggatcgccgtggagcaggacaagaacacccaggaggtgttcgcccaggtcaagcagatctacaagacgcccccgatcaaggacttcggcgggttcaacttcagccagatcctccccgacccctccaagcccagcaagcggtccttcatcgaggacctgctgttcaacaaggtgaccctcgccgacgccggcttcatcaagcagtacggcgactgcctgggggacatcgcggcccgcgacctgatctgcgcccagaagttcaacggcctcaccgtgctgccgcccctgctcaccgacgagatgatcgcccagtacaccagcgccctgctggcggggaccatcacgtccggctggaccttcggggccggcgccgccctccagatccccttcgcgatgcagatggcctaccggttcaacggcatcggggtcacccagaacgtgctgtacgagaaccagaagctgatcgccaaccagttcaacagcgccatcggcaagatccaggactccctcagctccaccgccagcgcgctggggaagctgcaggacgtggtcaaccagaacgcccaggccctcaacacgctggtgaagcagctgtccagcaacttcggcgccatctccagcgtgctcaacgacatcctgtcccgcctggacaaggtcgaggccgaggtgcagatcgaccggctcatcaccgggcgcctgcagagcctgcagacctacgtgacccagcagctcatccgggcggccgagatccgcgccagcgccaacctggccgcgaccaagatgtccgagtgcgtcctgggccagagcaagcgggtggacttctgcggcaaggggtaccacctcatgtccttcccccagagcgccccgcacggcgtggtcttcctgcacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctcgactccttcaaggaggagctggacaagtacttcaagaaccacaccagccccgacgtcgacctgggggacatctccggcatcaacgccagcgtggtgaacatccagaaggagatcgaccgcctcaacgaggtcgccaagaacctgaacgagtccctgatcgacctccaggagctggggaagtacgagcagtacatcaagtggccgtggtacatctggctgggcttcatcgccggcctcatcgcgatcgtgatggtgaccatcatgctgtgctgcatgaccagctgctgctcctgcctgaaggggtgctgcagctgcggctcctgctgcaagttcgacgaggacgacagcgagcccgtcctcaagggggtgaagctgcactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12782 - RNA, 4039 nt, synthetic construct
  misc_feature 1..4039: note SARS-CoV-2/SARS-CoV-2/Yunnan-01/human/2020/CHN__MT049951.1 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgccaacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12783 - RNA, 4039 nt, synthetic construct
  misc_feature 1..4039: note = SARS-CoV-2/USA/WA-UW292/2020__EPI_ISL_418077 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccagctccaccccctgcaacggcgtggaggggttcaactgctacttccccctgcagagctacggcttccagccgaccaacggggtgggctaccagccctaccgggtggtcgtgctgagcttcgagctcctgcacgcccccgccacggtgtgcgggcccaagaagtccaccaacctggtcaagaacaagtgcgtgaacttcaacttcaacggcctcaccggcaccggggtgctgaccgagagcaacaagaagttcctgccgttccagcagttcggccgcgacatcgccgacacgaccgacgcggtccgcgacccccagaccctggagatcctcgacatcaccccctgctccttcgggggcgtgagcgtgatcacgccggggaccaacacctccaaccaggtcgccgtgctgtaccaggacgtgaactgcaccgaggtccccgtggccatccacgccgaccagctgacgcccacctggcgggtgtacagcaccggctccaacgtcttccagacccgcgccggctgcctcatcggggcggagcacgtgaacaacagctacgagtgcgacatccccatcggcgccgggatctgcgcctcctaccagacgcagaccaacagcccgcggcgcgcccggtccgtggcgagccagtccatcatcgcctacaccatgagcctgggcgccgagaactccgtcgcctacagcaacaactccatcgccatccccaccaacttcacgatcagcgtgaccaccgagatcctgcccgtgagcatgaccaagacgtccgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccgggttcatcaagcagtacggcgactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggggccgccctgcagatccccttcgcgatgcagatggcctaccggttcaacggcatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacaaggtcgaggccgaggtgcagatcgaccggctgatcaccggccgcctccagagcctgcagacctacgtgacccagcagctgatccgggcggccgagatccgcgcctccgccaacctcgccgcgaccaagatgagcgagtgcgtcctggggcagtccaagcgggtggacttctgcggcaagggctaccacctgatgagcttcccccagtccgccccgcacggggtggtcttcctccacgtgacgtacgtccccgcccaggagaagaacttcaccaccgcccccgcgatctgccacgacggcaaggcccacttcccccgcgagggggtgttcgtgagcaacggcacccactggttcgtcacgcagcggaacttctacgagccgcagatcatcaccaccgacaacaccttcgtgtccgggaactgcgacgtggtcatcggcatcgtgaacaacacggtgtacgaccccctgcagcccgagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccgtggtacatctggctggggttcatcgccggcctgatcgcgatcgtgatggtgaccatcatgctctgctgcatgacctcctgctgcagctgcctgaagggctgctgctcctgcgggagctgctgcaagttcgacgaggacgactccgagcccgtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12784 - RNA, 4039 nt, synthetic construct
  misc_feature 1..4039: note = SARS-CoV-2/Iceland/192/2020__EPI_ISL_417819 spike protein mRNA gc (1-1273)
  source 1..4039: mol_type = other RNA
aggagaaagcttaccatgttcgtgttcttcgtcctgctccccctggtgagctcccagtgcgtgaacctgaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggacctgccccaggggttcagcgccctggagcccctcgtggacctgcccatcggcatcaacatcacccgcttccagaccctgctcgccctgcaccggtcctacctgacgccgggggacagcagctccggctggaccgcgggcgccgccgcctactacgtggggtacctccagccccgcaccttcctgctgaagtacaacgagaacggcaccatcacggacgcggtcgactgcgccctcgaccccctgagcgagaccaagtgcaccctgaagtccttcaccgtggagaaggggatctaccagacgagcaacttccgggtgcagcccaccgagtccatcgtccgcttcccgaacatcaccaacctctgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctgaacgacctctgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctggactccaaggtcgggggcaactacaactacctctaccgcctgttccgcaagagcaacctgaagcccttcgagcgggacatctccaccgagatctaccaggccggcagcaccccctgcaacggggtggagggcttcaactgctacttccccctccagtcctacgggttccagccgaccaacggcgtggggtaccagccctaccgggtggtcgtgctgagcttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgcgacccccagaccctggagatcctggacatcaccccctgcagcttcggcggggtgtccgtgatcacgccgggcaccaacaccagcaaccaggtcgccgtgctctaccagggcgtgaactgcaccgaggtccccgtggccatccacgccgaccagctgacgcccacctggcgggtgtactccaccgggagcaacgtcttccagacccgcgccggctgcctgatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctcggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctgctcctgcagtacgggtccttctgcacccagctgaaccgcgcgctcacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctgggcgacatcgcggcccgcgacctcatctgcgcccagaagttcaacgggctgaccgtgctgccgcccctcctgaccgacgagatgatcgcccagtacaccagcgccctgctcgcgggcaccatcacgtccgggtggaccttcggcgccggcgccgccctgcagatccccttcgcgatgcagatggcctaccggttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgtcccgcctcgacaaggtcgaggccgaggtgcagatcgaccggctgatcaccggccgcctgcagagcctccagacctacgtgacccagcagctgatccgggcggccgagatccgcgccagcgccaacctggccgcgaccaagatgtccgagtgcgtcctcggccagagcaagcgggtggacttctgcgggaagggctaccacctgatgtccttcccccagagcgccccgcacggggtggtcttcctgcacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctccagcccgagctggactccttcaaggaggagctggacaagtacttcaagaaccacaccagccccgacgtcgacctcggcgacatctccgggatcaacgccagcgtggtgaacatccagaaggagatcgaccgcctgaacgaggtcgccaagaacctgaacgagtccctcatcgacctgcaggagctgggcaagtacgagcagtacatcaagtggccgtggtacatctggctcggcttcatcgccgggctgatcgcgatcgtgatggtgaccatcatgctgtgctgcatgaccagctgctgctcctgcctcaagggctgctgcagctgcgggtcctgctgcaagttcgacgaggacgacagcgagcccgtcctgaagggcgtgaagctgcactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12785 - RNA, 4039 nt, synthetic construct
  misc_feature 1..4039: note = SARS-CoV-2/Belgium/ULG-6939/2020__EPI_ISL_417020 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgtgtactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggccgcggagatccgcgccagcgccaacctcgccgccaccaagatgtccgagtgcgtgctgggccagagcaagcgggtggacttctgcgggaagggctaccacctgatgtccttcccccagagcgcgccgcacggggtcgtgttcctccacgtcacgtacgtgcccgcccaggagaagaacttcaccaccgcccccgccatctgccacgacggcaaggcgcacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgccatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12786 - RNA, 4039 nt, synthetic construct
  misc_feature 1..4039: note = SARS-CoV-2/France/HF2496/2020__EPI_ISL_418231 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgtggcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggccgcggagatccgcgccagcgccaacctcgccgccaccaagatgtccgagtgcgtgctgggccagagcaagcgggtggacttctgcgggaagggctaccacctgatgtccttcccccagagcgcgccgcacggggtcgtgttcctccacgtcacgtacgtgcccgcccaggagaagaacttcaccaccgcccccgccatctgccacgacggcaaggcgcacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgccatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12787 - RNA, 4039 nt, synthetic construct
  misc_feature 1..4039: note = SARS-CoV-2/USA/WA-UW291/2020__EPI_ISL_418076 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccagtactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12788 - RNA, 4039 nt, synthetic construct
  misc_feature 1..4039: note = SARS-CoV-2/Portugal/PT0034/2020__EPI_ISL_418019 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatcaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12789 - RNA, 4039 nt, synthetic construct
  misc_feature 1..4039: note = SARS-CoV-2/Iceland/202/2020__EPI_ISL_417750 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatcccgggcatcaacgcctccgtggtgaacatccagaaggagatcgaccgcctgaacgaggtcgccaagaacctcaacgagagcctgatcgacctgcaggagctcgggaagtacgagcagtacatcaagtggccctggtacatctggctgggcttcatcgccggcctgatcgcgatcgtgatggtgaccatcatgctctgctgcatgacctcctgctgcagctgcctgaaggggtgctgctcctgcggcagctgctgcaagttcgacgaggacgactccgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12790 - RNA, 4039 nt, synthetic construct
  misc_feature 1..4039: note = SARS-CoV-2/USA/WA-UW261/2020__EPI_ISL_418046 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcacgagcgtctacgcctggaaccgcaagcggatctccaactgcgtggccgactacagcgtgctgtacaactccgcgagcttctccaccttcaagtgctacggcgtcagccccaccaagctcaacgacctgtgcttcaccaacgtgtacgccgactccttcgtgatccgcggggacgaggtccggcagatcgcccccggccagacggggaagatcgccgactacaactacaagctgccggacgacttcaccggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgacgaacggcgtggggtaccagccctaccgggtggtcgtgctgagcttcgagctcctgcacgcccccgccaccgtgtgcggccccaagaagtccaccaacctggtcaagaacaagtgcgtgaacttcaacttcaacggcctcaccgggaccggcgtgctgacggagagcaacaagaagttcctgccgttccagcagttcgggcgcgacatcgccgacaccaccgacgccgtccgcgacccccagaccctggagatcctcgacatcacgccctgcagcttcggcggggtgtccgtgatcaccccgggcaccaacaccagcaaccaggtcgcggtgctgtaccaggacgtgaactgcacggaggtccccgtggccatccacgccgaccagctgacccccacctggcgggtgtactccaccggcagcaacgtcttccagacgcgcgccgggtgcctcatcggcgccgagcacgtgaacaactcctacgagtgcgacatccccatcggggcgggcatctgcgccagctaccagacccagaccaactccccgcggcgcgcccggagcgtggcctcccagagcatcatcgcgtacaccatgtccctgggcgccgagaacagcgtcgcctactccaacaacagcatcgccatccccacgaacttcaccatctccgtgaccaccgagatcctgcccgtgagcatgacgaagaccagcgtcgactgcaccatgtacatctgcggggactccaccgagtgcagcaacctcctgctgcagtacggctccttctgcacgcagctcaaccgcgccctgaccgggatcgcggtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgccgcgcgcgacctgatctgcgcccagaagttcaacggcctgaccgtgctcccgcccctgctgaccgacgagatgatcgcccagtacaccagcgccctcctggccgggacgatcacctccggctggaccttcggggcgggcgccgccctgcagatccccttcgccatgcagatggcgtaccggttcaacggcatcggggtcacccagaacgtgctctacgagaaccagaagctgatcgccaaccagttcaacagcgccatcggcaagatccaggactccctgagctccacggccagcgccctcgggaagctgcaggacgtggtcaaccagaacgcgcaggccctgaacaccctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggccgcggagatccgcgccagcgccaacctcgccgccacgaagatgtccgagtgcgtcctgggccagagcaagcgggtggacttctgcggcaaggggtaccacctgatgtccttcccccagagcgcgccgcacggcgtggtcttcctccacgtgacctacgtccccgcccaggagaagaacttcaccaccgcccccgccatctgccacgacgggaaggcgcacttcccccgcgagggcgtgttcgtgtccaacgggacgcactggttcgtcacccagcggaacttctacgagccgcagatcatcaccaccgacaacacgttcgtgagcggcaactgcgacgtggtcatcggcatcgtgaacaacaccgtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgccatcgtgatggtgaccatcatgctctgctgcatgacgagctgctgctcctgcctgaaggggtgctgcagctgcggctcctgctgcaagttcgacgaggacgacagcgagcccgtcctgaagggggtgaagctccactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12791 - RNA, 4039 nt, synthetic construct
  misc_feature 1..4039: note = SARS-CoV-2/Portugal/PT0035/2020__EPI_ISL_418020 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcagcgcgcgcgacctgatctgcgcccagaagttcaacggcctgaccgtgctcccgcccctgctgaccgacgagatgatcgcccagtacacctccgccctcctggccgggaccatcacgagcggctggaccttcggggcgggcgccgccctgcagatccccttcgccatgcagatggcgtaccggttcaacggcatcggggtcacccagaacgtgctctacgagaaccagaagctgatcgccaaccagttcaactccgccatcggcaagatccaggacagcctgtccagcaccgcctccgccctcgggaagctgcaggacgtggtcaaccagaacgcgcaggccctgaacacgctcgtgaagcagctgagctccaacttcggcgccatcagctccgtgctgaacgacatcctcagccgcctggacaaggtcgaggccgaggtgcagatcgaccggctgatcaccgggcgcctccagagcctgcagacctacgtgacccagcagctgatccgggccgcggagatccgcgcctccgccaacctcgccgccaccaagatgagcgagtgcgtcctgggccagtccaagcgggtggacttctgcggcaaggggtaccacctgatgagcttcccccagtccgcgccgcacggcgtggtcttcctccacgtgacgtacgtccccgcccaggagaagaacttcaccaccgcccccgccatctgccacgacgggaaggcgcacttcccccgcgagggcgtgttcgtgagcaacgggacccactggttcgtcacgcagcggaacttctacgagccgcagatcatcaccaccgacaacaccttcgtgtccggcaactgcgacgtggtcatcggcatcgtgaacaacacggtgtacgaccccctgcagcccgagctggacagcttcaaggaggagctcgacaagtacttcaagaaccacacctcccccgacgtcgacctgggggacatcagcggcatcaacgcctccgtggtgaacatccagaaggagatcgaccgcctgaacgaggtcgccaagaacctcaacgagagcctgatcgacctgcaggagctcgggaagtacgagcagtacatcaagtggccgtggtacatctggctgggcttcatcgccggcctgatcgccatcgtgatggtgaccatcatgctctgctgcatgacctcctgctgcagctgcctgaaggggtgctgctcctgcggcagctgctgcaagttcgacgaggacgactccgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12792 - RNA, 4039 nt, synthetic construct
  misc_feature 1..4039: note = SARS-CoV-2/USA/NY-NYUMC7/2020__EPI_ISL_418192 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12793 - RNA, 4039 nt, synthetic construct
  misc_feature 1..4039: note = SARS-CoV-2/Iceland/189/2020__EPI_ISL_417709 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcaccaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcacgatcacctccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccacggccagcgcgctcggcaagctgcaggacgtggtcaaccagaacgcccaggccctgaacaccctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgacgaagatgtccgagtgcgtcctgggccagagcaagcgggtggacttctgcgggaagggctaccacctgatgtccttcccccagagcgccccgcacggggtggtcttcctccacgtgacctacgtccccgcccaggagaagaacttcaccaccgcccccgcgatctgccacgacggcaaggcccacttcccccgcgagggggtgttcgtgtccaacggcacgcactggttcgtcacccagcggaacttctacgagccgcagatcatcaccaccgacaacacgttcgtgagcggcaactgcgacgtggtcatcgggatcgtgaacaacaccgtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgacgagctgctgctcctgcctgaagggctgctgcagctgcgggtcctgctgcaagttcgacgaggacgacagcgagcccgtcctgaagggcgtgaagctccactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12794 - RNA, 4039 nt, synthetic construct
  misc_feature 1..4039: note = SARS-CoV-2/Australia/NSW56/2020__EPI_ISL_417408 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgactccagcaagccctccaagcggagcttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctgcccccgctcctgaccgacgagatgatcgcccagtacacctccgccctcctggcggggaccatcacgagcggctggaccttcggggccggcgccgccctgcagatccccttcgcgatgcagatggcctaccggttcaacggcatcggggtcacccagaacgtgctctacgagaaccagaagctgatcgccaaccagttcaactccgccatcggcaagatccaggacagcctgtccagcaccgcctccgcgctcgggaagctgcaggacgtggtcaaccagaacgcccaggccctgaacacgctcgtgaagcagctgagctccaacttcggcgccatcagctccgtgctgaacgacatcctcagccgcctggacaaggtcgaggccgaggtgcagatcgaccggctgatcaccgggcgcctccagagcctgcagacctacgtgacccagcagctgatccgggcggccgagatccgcgcctccgccaacctcgccgcgaccaagatgagcgagtgcgtcctgggccagtccaagcgggtggacttctgcggcaaggggtaccacctgatgagcttcccccagtccgcgccccacggcgtggtcttcctccacgtgacgtacgtcccggcccaggagaagaacttcaccaccgcccccgccatctgccacgacgggaaggcccacttcccccgcgagggcgtgttcgtgagcaacgggacccactggttcgtcacgcagcggaacttctacgagccccagatcatcaccaccgacaacaccttcgtgtccggcaactgcgacgtggtcatcggcatcgtgaacaacacggtgtacgacccgctgcagcccgagctggacagcttcaaggaggagctcgacaagtacttcaagaaccacacctcccccgacgtcgacctgggggacatcagcggcatcaacgcctccgtggtgaacatccagaaggagatcgaccgcctgaacgaggtcgccaagaacctcaacgagagcctgatcgacctgcaggagctcgggaagtacgagcagtacatcaagtggccctggtacatctggctgggcttcatcgccggcctgatcgcgatcgtgatggtgaccatcatgctctgctgcatgacctcctgctgcagctgcctgaaggggtgctgctcctgcggcagctgctgcaagttcgacgaggacgactccgagccggtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12795 - RNA, 4039 nt, synthetic construct
  misc_feature 1..4039: note = SARS-CoV-2/Iceland/280/2020__EPI_ISL_417608 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccacacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12796 - RNA, 4039 nt, synthetic construct
  misc_feature 1..4039: note = SARS-CoV-2/Iceland/247/2020__EPI_ISL_417575 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatcgtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12797 - RNA, 4039 nt, synthetic construct
  misc_feature 1..4039: note = SARS-CoV-2/Iceland/238/2020__EPI_ISL_417566 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgtgggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggccgcggagatccgcgccagcgccaacctcgccgccaccaagatgtccgagtgcgtgctgggccagagcaagcgggtggacttctgcgggaagggctaccacctgatgtccttcccccagagcgcgccgcacggggtcgtgttcctccacgtcacgtacgtgcccgcccaggagaagaacttcaccaccgcccccgccatctgccacgacggcaaggcgcacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgccatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12798 - RNA, 4039 nt, synthetic construct
  misc_feature 1..4039: note = SARS-CoV-2/Greece/16/2020__EPI_ISL_418265 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacgtcgacggctacttcaagatctactccaagcacaccccgatcaacctggtgcgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtcgggtacctgcagccccgcaccttcctgctcaagtacaacgagaacggcaccatcacggacgcggtggactgcgccctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggcggactacagcgtcctgtacaactccgccagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgcggtgcgcgacccccagaccctggagatcctcgacatcaccccctgcagcttcggcggggtgtccgtcatcacgccgggcaccaacaccagcaaccaggtggccgtgctgtaccaggacgtcaactgcaccgaggtgcccgtggccatccacgccgaccagctgacgcccacctggcgggtctactccaccggcagcaacgtgttccagacccgcgccgggtgcctcatcggcgcggagcacgtgaacaactcctacgagtgcgacatccccatcggggccggcatctgcgccagctaccagacgcagaccaactccccgcggcgcgcccggagcgtcgcgtcccagagcatcatcgcctacaccatgtccctgggcgccgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgcgcgctgacggggatcgccgtggagcaggacaagaacacccaggaggtcttcgcccaggtgaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtcctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtgacccagaacgtgctctacgagaaccagaagctgatcgccaaccagttcaacagcgccatcggcaagatccaggactccctgagctccaccgccagcgcgctcgggaagctgcaggacgtcgtgaaccagaacgcccaggccctgaacacgctcgtgaagcagctgtccagcaacttcggcgccatctccagcgtcctgaacgacatcctctcccgcctggacaaggtggaggccgaggtgcagatcgaccggctgatcaccgggcgcctccagagcctgcagacctacgtcacccagcagctgatccgggcggccgagatccgcgccagcgccaacctcgccgcgaccaagatgtccgagtgcgtgctgggccagagcaagcgggtggacttctgcggcaaggggtaccacctgatgtccttcccccagagcgccccgcacggcgtcgtgttcctccacgtcacgtacgtgcccgcccaggagaagaacttcaccaccgcccccgcgatctgccacgacgggaaggcccacttcccccgcgagggcgtgttcgtctccaacgggacccactggttcgtgacgcagcggaacttctacgagccgcagatcatcaccaccgacaacaccttcgtgagcggcaactgcgacgtcgtgatcggcatcgtgaacaacacggtctacgaccccctgcagcccgagctggactccttcaaggaggagctcgacaagtacttcaagaaccacaccagccccgacgtggacctgggggacatctccggcatcaacgccagcgtggtcaacatccagaaggagatcgaccgcctgaacgaggtggccaagaacctcaacgagtccctgatcgacctgcaggagctcgggaagtacgagcagtacatcaagtggccgtggtacatctggctgggcttcatcgccggcctgatcgcgatcgtgatggtcaccatcatgctctgctgcatgaccagctgctgctcctgcctgaaggggtgctgcagctgcggctcctgctgcaagttcgacgaggacgacagcgagcccgtgctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12799 - RNA, 4039 nt, synthetic construct
  misc_feature 1..4039: note = SARS-CoV-2/Iceland/319/2020__EPI_ISL_417648 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatcgacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12800 - RNA, 4039 nt, synthetic construct
  misc_feature 1..4039: note = SARS-CoV-2/Congo/94/2020__EPI_ISL_417947 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacatcctcttcaacaaggtgaccctggccgacgccggcttcatcaagcagtacggggactgcctgggcgacatcgcggcccgcgacctcatctgcgcccagaagttcaacgggctgaccgtgctgccgcccctcctgaccgacgagatgatcgcccagtacaccagcgccctgctcgcgggcaccatcacgtccgggtggaccttcggcgccggcgccgccctgcagatccccttcgcgatgcagatggcctaccggttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgtcccgcctcgacaaggtcgaggccgaggtgcagatcgaccggctgatcaccggccgcctgcagagcctccagacctacgtgacccagcagctgatccgggcggccgagatccgcgccagcgccaacctggccgcgaccaagatgtccgagtgcgtcctcggccagagcaagcgggtggacttctgcgggaagggctaccacctgatgtccttcccccagagcgccccgcacggggtggtcttcctgcacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctccagcccgagctggactccttcaaggaggagctggacaagtacttcaagaaccacaccagccccgacgtcgacctcggcgacatctccgggatcaacgccagcgtggtgaacatccagaaggagatcgaccgcctgaacgaggtcgccaagaacctgaacgagtccctcatcgacctgcaggagctgggcaagtacgagcagtacatcaagtggccgtggtacatctggctcggcttcatcgccgggctgatcgcgatcgtgatggtgaccatcatgctgtgctgcatgaccagctgctgctcctgcctcaagggctgctgcagctgcgggtcctgctgcaagttcgacgaggacgacagcgagcccgtcctgaagggcgtgaagctgcactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12801 - RNA, 4039 nt, synthetic construct
  misc_feature 1..4039: note = SARS-CoV-2/Congo/158/2020__EPI_ISL_417950 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcctgagcggcaactgcgacgtggtgatcggcatcgtcaacaacacggtgtacgaccccctgcagcccgagctcgactccttcaaggaggagctggacaagtacttcaagaaccacaccagccccgacgtggacctgggggacatctccggcatcaacgccagcgtcgtgaacatccagaaggagatcgaccgcctcaacgaggtggccaagaacctgaacgagtccctgatcgacctccaggagctggggaagtacgagcagtacatcaagtggccgtggtacatctggctgggcttcatcgccggcctcatcgcgatcgtcatggtgaccatcatgctgtgctgcatgaccagctgctgctcctgcctgaaggggtgctgcagctgcggctcctgctgcaagttcgacgaggacgacagcgagcccgtgctcaagggggtcaagctgcactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12802 - RNA, 4039 nt, synthetic construct
  misc_feature 1..4039: note = SARS-CoV-2/USA/UT-00034/2020__EPI_ISL_417977 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactactacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12803 - RNA, 4039 nt, synthetic construct
  misc_feature 1..4039: note = SARS-CoV-2/USA/UT-00033/2020__EPI_ISL_417976 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggcctgaccgcgggcgccgccgcctactacgtggggtacctgcagccccgcaccttcctcctgaagtacaacgagaacggcaccatcacggacgcggtcgactgcgccctggaccccctcagcgagaccaagtgcaccctgaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctctacaactccgccagcttctccacgttcaagtgctacggcgtcagccccaccaagctgaacgacctgtgcttcaccaacgtgtacgccgactccttcgtgatccgcggggacgaggtccggcagatcgcccccggccagaccgggaagatcgccgactacaactacaagctcccggacgacttcacgggctgcgtgatcgcgtggaacagcaacaacctggactccaaggtcgggggcaactacaactacctgtaccgcctcttccgcaagagcaacctgaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctcagcttcgagctgctgcacgcccccgccacggtgtgcggccccaagaagtccaccaacctcgtcaagaacaagtgcgtgaacttcaacttcaacggcctgaccgggaccggcgtgctgaccgagagcaacaagaagttcctgccgttccagcagttcgggcgcgacatcgccgacacgaccgacgcggtccgcgacccccagaccctcgagatcctggacatcaccccctgcagcttcggcggggtgtccgtgatcacgccgggcaccaacaccagcaaccaggtcgccgtgctgtaccagggcgtgaactgcaccgaggtccccgtggccatccacgccgaccagctcacgcccacctggcgggtgtactccaccgggagcaacgtcttccagacccgcgccggctgcctgatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctccccgtgagcatgaccaagacgagcgtcgactgcaccatgtacatctgcggcgactccaccgagtgcagcaacctgctgctccagtacgggtccttctgcacccagctgaaccgcgcgctgacgggcatcgccgtggagcaggacaagaacacccaggaggtgttcgcccaggtcaagcagatctacaagacgcccccgatcaaggacttcgggggcttcaacttcagccagatcctccccgacccctccaagcccagcaagcggtccttcatcgaggacctgctgttcaacaaggtgaccctcgccgacgccggcttcatcaagcagtacggggactgcctgggcgacatcgcggcccgcgacctgatctgcgcccagaagttcaacgggctcaccgtgctgccgcccctgctcaccgacgagatgatcgcccagtacaccagcgccctgctggcgggcaccatcacgtccgggtggaccttcggcgccggcgccgccctccagatccccttcgcgatgcagatggcctaccggttcaacgggatcggcgtcacccagaacgtgctgtacgagaaccagaagctgatcgccaaccagttcaacagcgccatcgggaagatccaggactccctcagctccaccgccagcgcgctgggcaagctgcaggacgtggtcaaccagaacgcccaggccctcaacacgctggtgaagcagctgtccagcaacttcggggccatctccagcgtgctcaacgacatcctgtcccgcctggacaaggtcgaggccgaggtgcagatcgaccggctcatcaccggccgcctgcagagcctgcagacctacgtgacccagcagctcatccgggcggccgagatccgcgccagcgccaacctggccgcgaccaagatgtccgagtgcgtcctgggccagagcaagcgggtggacttctgcgggaagggctaccacctcatgtccttcccccagagcgccccgcacggggtggtcttcctgcacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctcgactccttcaaggaggagctggacaagtacttcaagaaccacaccagccccgacgtcgacctgggcgacatctccgggatcaacgccagcgtggtgaacatccagaaggagatcgaccgcctcaacgaggtcgccaagaacctgaacgagtccctgatcgacctccaggagctgggcaagtacgagcagtacatcaagtggccgtggtacatctggctgggcttcatcgccgggctcatcgcgatcgtgatggtgaccatcatgctgtgctgcatgaccagctgctgctcctgcctgaagggctgctgcagctgcgggtcctgctgcaagttcgacgaggacgacagcgagcccgtcctcaagggcgtgaagctgcactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12804 - RNA, 4039 nt, synthetic construct
  misc_feature 1..4039: note = SARS-CoV-2/USA/WI-13/2020__EPI_ISL_417516 spike protein mRNA gc (1-1273)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgctgcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctctacaactccgccagcttctccacgttcaagtgctacggcgtcagccccaccaagctgaacgacctgtgcttcaccaacgtgtacgccgactccttcgtgatccgcggggacgaggtccggcagatcgcccccggccagaccgggaagatcgccgactacaactacaagctcccggacgacttcacgggctgcgtgatcgcgtggaacagcaacaacctggactccaaggtcgggggcaactacaactacctgtaccgcctcttccgcaagagcaacctgaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctcagcttcgagctgctgcacgcccccgccacggtgtgcggccccaagaagtccaccaacctcgtcaagaacaagtgcgtgaacttcaacttcaacggcctgaccgggaccggcgtgctgaccgagagcaacaagaagttcctgccgttccagcagttcgggcgcgacatcgccgacacgaccgacgcggtccgcgacccccagaccctcgagatcctggacatcaccccctgcagcttcggcggggtgtccgtgatcacgccgggcaccaacaccagcaaccaggtcgccgtgctgtaccagggcgtgaactgcaccgaggtccccgtggccatccacgccgaccagctcacgcccacctggcgggtgtactccaccgggagcaacgtcttccagacccgcgccggctgcctgatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctccccgtgagcatgaccaagacgagcgtcgactgcaccatgtacatctgcggcgactccaccgagtgcagcaacctgctgctccagtacgggtccttctgcacccagctgaaccgcgcgctgacgggcatcgccgtggagcaggacaagaacacccaggaggtgttcgcccaggtcaagcagatctacaagacgcccccgatcaaggacttcgggggcttcaacttcagccagatcctccccgacccctccaagcccagcaagcggtccttcatcgaggacctgctgttcaacaaggtgaccctcgccgacgccggcttcatcaagcagtacggggactgcctgggcgacatcgcggcccgcgacctgatctgcgcccagaagttcaacgggctcaccgtgctgccgcccctgctcaccgacgagatgatcgcccagtacaccagcgccctgctggcgggcaccatcacgtccgggtggaccttcggcgccggcgccgccctccagatccccttcgcgatgcagatggcctaccggttcaacgggatcggcgtcacccagaacgtgctgtacgagaaccagaagctgatcgccaaccagttcaacagcgccatcgggaagatccaggactccctcagctccaccgccagcgcgctgggcaagctgcaggacgtggtcaaccagaacgcccaggccctcaacacgctggtgaagcagctgtccagcaacttcggggccatctccagcgtgctcaacgacatcctgtcccgcctggacaaggtcgaggccgaggtgcagatcgaccggctcatcaccggccgcctgcagagcctgcagacctacgtgacccagcagctcatccgggcggccgagatccgcgccagcgccaacctggccgcgaccaagatgtccgagtgcgtcctgggccagagcaagcgggtggacttctgcgggaagggctaccacctcatgtccttcccccagagcgccccgcacggggtggtcttcctgcacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctcgactccttcaaggaggagctggacaagtacttcaagaaccacaccagccccgacgtcgacctgggcgacatctccgggatcaacgccagcgtggtgaacatccagaaggagatcgaccgcctcaacgaggtcgccaagaacctgaacgagtccctgatcgacctccaggagctgggcaagtacgagcagtacatcaagtggccgtggtacatctggctgggcttcatcgccgggctcatcgcgatcgtgatggtgaccatcatgctgtgctgcatgaccagctgctgctcctgcctgaagggctgctgcagctgcgggtcctgctgcaagttcgacgaggacgacagcgagcccgtcctcaagggcgtgaagctgcactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12805 - RNA, 4036 nt, synthetic construct
  misc_feature 1..4036: note = SARS-CoV-2/India/1-27/2020__EPI_ISL_413522 spike protein mRNA gc (1-1272)
  source 1..4036: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtcatccagatcgcccccggccagaccgggaagatcgccgactacaactacaagctgccggacgacttcacgggctgcgtgatcgcgtggaacagcaacaacctcgactccaaggtcgggggcaactacaactacctgtaccggctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgcgtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgggacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggggccggcatctgcgccagctaccagacgcagaccaactccccgcgccgggcccgcagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgggcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcgctccttcatcgaggacctcctgttcaacaaggtgaccctggccgacgccggcttcatcaagcagtacggcgactgcctcggggacatcgcggcccgggacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccgcttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccggctggacaaggtcgaggccgaggtgcagatcgaccgcctgatcaccgggcggctccagagcctgcagacctacgtgacccagcagctgatccgcgcggccgagatccgggccagcgccaacctcgccgcgaccaagatgtccgagtgcgtcctgggccagagcaagcgcgtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgggagggcgtgttcgtgtccaacgggacccactggttcgtcacgcagcgcaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccggctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12806 - RNA, 4021 nt, synthetic construct
  misc_feature 1..4021: note = SARS-CoV-2/pangolin/Guangxi/P4L/2017__EPI_ISL_410538 spike protein mRNA gc (1-1267)
  source 1..4021: mol_type = other RNA
aggagaaagcttaccatgttcgtgttcctgttcgtcctccccctggtgagctcccagtgcgtgaacctgaccacccgcacgggcatcccgcccgggtacaccaacagctccacccggggcgtctactaccccgacaaggtgttccgcagctccatcctccacctgacccaggacctgttcctccccttcttcagcaacgtgacgtggttcaacaccatcaactaccagggcgggttcaagaagttcgacaacccggtcctgcccttcaacgacggggtgtacttcgcctccaccgagaagtccaacatcatccggggctggatcttcggcaccacgctggacgcccgcacccagagcctcctgatcgtgaacaacgcgaccaacgtcgtgatcaaggtgtgcgagttccagttctgcaccgaccccttcctgggggtctactaccacaacaacaacaagacgtgggtggagaacgagttccgggtgtacagctccgccaacaactgcaccttcgagtacatcagccagcccttcctcatggacctggagggcaagcaggggaacttcaagaacctgcgcgagttcgtcttcaagaacgtggacggctacttcaagatctactccaagcacaccccgatcgacctcgtgcgggacctgccccgcgggttcgccgccctggagcccctcgtcgacctgcccatcggcatcaacatcacccggttccagacgctgctcgccctgcaccgcagctacctgaccccgggcaacctcgagtccgggtggaccaccggcgcggccgcctactacgtggggtacctgcagcagcggacgttcctgctcagctacaaccagaacggcaccatcaccgacgccgtggactgctccctggaccccctgagcgagaccaagtgcacgctcaagtccctgaccgtcgagaagggcatctaccagaccagcaacttccgcgtgcagcccaccatcagcatcgtgcggttccccaacatcacgaacctgtgcccgttcggggaggtcttcaacgcgtccaagttcgccagcgtgtacgcctggaaccgcaagcggatctccaactgcgtcgccgactacagcgtgctctacaactccaccagcttctccaccttcaagtgctacggcgtgagccccaccaagctgaacgacctgtgcttcacgaacgtctacgccgactccttcgtggtgaagggggacgaggtccgccagatcgcgcccggccagaccggggtgatcgccgactacaactacaagctccccgacgacttcaccggctgcgtgatcgcctggaacagcgtcaagcaggacgccctgaccggcgggaactacggctacctgtaccgcctcttccggaagtccaagctgaagccgttcgagcgggacatcagcacggagatctaccaggccgggtccaccccctgcaacggccaggtggggctgaactgctactaccccctcgagcgctacggcttccaccccaccaccggcgtgaactaccagccgttccgggtcgtggtgctgagcttcgagctgctcaacgggcccgcgaccgtctgcggccccaagctgtccacgaccctggtgaaggacaagtgcgtgaacttcaacttcaacgggctgaccggcaccggggtcctcacgaccagcaagaagcagttcctgcccttccagcagttcggccgcgacatctccgacaccaccgacgccgtgcgcgacccgcagacgctggagatcctcgacatcaccccctgcagcttcggcggggtgtccgtcatcacccccggcaccaacacgagcaaccaggtggccgtgctgtaccaggacgtcaactgcaccgaggtgccgatggccatccacgccgagcagctgacccccgcgtggcgggtgtacagcgccggggccaacgtcttccagacccgcgccggctgcctcgtgggcgccgagcacgtgaacaactcctacgagtgcgacatccccgtcggggcgggcatctgcgccagctaccactccatgagctccctgcggagcgtgaaccagcgctccatcatcgcctacacgatgagcctgggggccgagaactccgtggcgtacagcaacaactccatcgccatccccaccaacttcaccatcagcgtcaccacggagatcctcccggtgtccatgaccaagaccagcgtggactgcaccatgtacatctgcggcgactccatcgagtgcagcaacctgctgctccagtacgggtccttctgcacgcagctgaaccgggccctgaccggcatcgccgtcgagcaggacaagaacacccaggaggtgttcgcccaggtgaagcagatctacaagaccccgcccatcaaggacttcggcgggttcaacttcagccagatcctccccgaccccagcaagccctccaagcgcagcttcatcgaggacctgctgttcaacaaggtcacgctcgcggacgccggcttcatcaagcagtacggggactgcctgggcgacatcgccgcccgggacctgatctgcgcccagaagttcaacgggctcaccgtgctgccgcccctgctcaccgacgagatgatcgcgcagtacacctccgccctgctggccggcacgatcaccagcggctggaccttcggggccggcgccgcgctccagatccccttcgccatgcagatggcctaccgcttcaacgggatcggcgtgacccagaacgtcctgtacgagaaccagaagctgatcgccaaccagttcaactccgcgatcgggaagatccaggacagcctctccagcacggcctccgccctgggcaagctgcaggacgtggtgaaccagaacgcccaggccctcaacaccctggtcaagcagctgagctccaacttcggcgcgatcagctccgtgctcaacgacatcctgagccggctggacaaggtggaggccgaggtccagatcgaccgcctcatcaccgggcggctgcagtccctgcagacctacgtgacccagcagctcatccgcgccgccgagatccgggccagcgcgaacctggccgccacgaagatgtccgagtgcgtgctgggccagagcaagcgcgtcgacttctgcgggaagggctaccacctcatgtccttcccccagagcgcgccccacggggtggtcttcctgcacgtgacctacgtgcccgcccaggagaagaacttcaccaccgccccggccatctgccacgagggcaaggcccacttcccccgggagggcgtcttcgtgagcaacgggacgcactggttcatcacccagcgcaacttctacgagccccagatcatcaccaccgacaacacgttcgtgtccggcagctgcgacgtcgtgatcgggatcgtgaacaacaccgtctacgaccccctgcagccggagctcgactccttcaaggaggagctggacaagtacttcaagaaccacaccagccccgacgtggacctgggcgacatctccggcatcaacgccagcgtggtcaacatccagaaggagatcgaccggctcaacgaggtggcgaagaacctgaacgagtcccccatcgacctgcaggagctcgggaagtacgagcagtacatcaagtggccctggtacatctggctgggcttcatcgccgggctgatcgccatcatcatggtgaccatcatgctctgctgcatgacgagctgctgctcctgcctgaagggctgctgcagctgcgggtcctgctgcaagttcgacgaggacgacagcgagccggtcctgaagggcgtgaagctccactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12807 - RNA, 4021 nt, synthetic construct
  misc_feature 1..4021: note = SARS-CoV-2/pangolin/Guangxi/P5L/2017__EPI_ISL_410540 spike protein mRNA gc (1-1267)
  source 1..4021: mol_type = other RNA
aggagaaagcttaccatgttcgtgttcctgttcgtcctccccctggtgagctcccagtgcgtgaacctgaccacccgcacgggcatcccgcccgggtacaccaacagctccacccggggcgtctactaccccgacaaggtgttccgcagctccatcctccacctgacccaggacctgttcctccccttcttcagcaacgtgacgtggttcaacaccatcaactaccagggcgggttcaagaagttcgacaacccggtcctgcccttcaacgacggggtgtacttcgcctccaccgagaagtccaacatcatccggggctggatcttcggcaccacgctggacgcccgcacccagagcctcctgatcgtgaacaacgcgaccaacgtcgtgatcaaggtgtgcgagttccagttctgcaccgaccccttcctgggggtctactaccacaacaacaacaagacgtgggtggagaacgagttccgggtgtacagctccgccaacaactgcaccttcgagtacatcagccagcccttcctcatggacctggagggcaagcaggggaacttcaagaacctgcgcgagttcgtcttcaagaacgtggacggctacttcaagatctactccaagcacaccccgatcgacctcgtgcgggacctgccccgcgggttcgccgccctggagcccctcgtcgacctgcccatcggcatcaacatcacccggttccagacgctgctcgccctgcaccgcagctacctgaccccgggcaagctcgagtccgggtggaccaccggcgcggccgcctactacgtggggtacctgcagcagcggacgttcctgctcagctacaaccagaacggcaccatcaccgacgccgtggactgctccctggaccccctgagcgagaccaagtgcacgctcaagtccctgaccgtcgagaagggcatctaccagaccagcaacttccgcgtgcagcccaccatcagcatcgtgcggttccccaacatcacgaacctgtgcccgttcggggaggtcttcaacgcgtccaagttcgccagcgtgtacgcctggaaccgcaagcggatctccaactgcgtcgccgactacagcgtgctctacaactccaccagcttctccaccttcaagtgctacggcgtgagccccaccaagctgaacgacctgtgcttcacgaacgtctacgccgactccttcgtggtgaagggggacgaggtccgccagatcgcgcccggccagaccggggtgatcgccgactacaactacaagctccccgacgacttcaccggctgcgtgatcgcctggaacagcgtcaagcaggacgccctgaccggcgggaactacggctacctgtaccgcctcttccggaagtccaagctgaagccgttcgagcgggacatcagcacggagatctaccaggccgggtccaccccctgcaacggccaggtggggctgaactgctactaccccctcgagcgctacggcttccaccccaccaccggcgtgaactaccagccgttccgggtcgtggtgctgagcttcgagctgctcaacgggcccgcgaccgtctgcggccccaagctgtccacgaccctggtgaaggacaagtgcgtgaacttcaacttcaacgggctgaccggcaccggggtcctcacgaccagcaagaagcagttcctgcccttccagcagttcggccgcgacatctccgacaccaccgacgccgtgcgcgacccgcagacgctggagatcctcgacatcaccccctgcagcttcggcggggtgtccgtcatcacccccggcaccaacacgagcaaccaggtggccgtgctgtaccaggacgtcaactgcaccgaggtgccgatggccatccacgccgagcagctgacccccgcgtggcgggtgtacagcgccggggccaacgtcttccagacccgcgccggctgcctcgtgggcgccgagcacgtgaacaactcctacgagtgcgacatccccgtcggggcgggcatctgcgccagctaccactccatgagctccttccggagcgtgaaccagcgctccatcatcgcctacacgatgagcctgggggccgagaactccgtggcgtacagcaacaactccatcgccatccccaccaacttcaccatcagcgtcaccacggagatcctgccggtgtccatgaccaagaccagcgtggactgcaccatgtacatctgcggcgactccatcgagtgcagcaacctcctgctgcagtacgggtccttctgcacgcagctcaaccgggccctgaccggcatcgccgtcgagcaggacaagaacacccaggaggtgttcgcccaggtgaagcagatctacaagaccccgcccatcaaggacttcggcgggttcaacttcagccagatcctgcccgaccccagcaagccctccaagcgcagcttcatcgaggacctcctgttcaacaaggtcacgctggcggacgccggcttcatcaagcagtacggggactgcctcggcgacatcgccgcccgggacctgatctgcgcccagaagttcaacgggctgaccgtgctcccgcccctgctgaccgacgagatgatcgcgcagtacacctccgccctcctggccggcacgatcaccagcggctggaccttcggggccggcgccgcgctgcagatccccttcgccatgcagatggcctaccgcttcaacgggatcggcgtgacccagaacgtcctctacgagaaccagaagctgatcgccaaccagttcaactccgcgatcgggaagatccaggacagcctgtccagcacggcctccgccctcggcaagctgcaggacgtggtgaaccagaacgcccaggccctgaacaccctcgtcaagcagctgagctccaacttcggcgcgatcagctccgtgctgaacgacatcctcagccggctggacaaggtggaggccgaggtccagatcgaccgcctgatcaccgggcggctccagtccctgcagacctacgtgacccagcagctgatccgcgccgccgagatccgggccagcgcgaacctcgccgccacgaagatgtccgagtgcgtgctgggccagagcaagcgcgtcgacttctgcgggaagggctaccacctgatgtccttcccccagagcgcgccccacggggtggtcttcctccacgtgacctacgtgcccgcccaggagaagaacttcaccaccgccccggccatctgccacgagggcaaggcccacttcccccgggagggcgtcttcgtgagcaacgggacgcactggttcatcacccagcgcaacttctacgagccccagatcatcaccaccgacaacacgttcgtgtccggcagctgcgacgtcgtgatcgggatcgtgaacaacaccgtctacgaccccctgcagccggagctggactccttcaaggaggagctcgacaagtacttcaagaaccacaccagccccgacgtggacctgggcgacatctccggcatcaacgccagcgtggtcaacatccagaaggagatcgaccggctgaacgaggtggcgaagaacctcaacgagtccctgatcgacctgcaggagctcgggaagtacgagcagtacatcaagtggccctggtacatctggctgggcttcatcgccgggctgatcgccatcatcatggtgaccatcatgctctgctgcatgacgagctgctgctcctgcctgaagggctgctgcagctgcgggtcctgctgcaagttcgacgaggacgacagcgagcccgtcctgaagggcgtgaagctccactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12808 - RNA, 4021 nt, synthetic construct
  misc_feature 1..4021: note = SARS-CoV-2/pangolin/Guangxi/P5E/2017__EPI_ISL_410541 spike protein mRNA gc (1-1267)
  source 1..4021: mol_type = other RNA
aggagaaagcttaccatgttcgtgttcctgttcgtcctccccctggtgagctcccagtgcgtgaacctgaccacccgcacgggcatcccgcccgggtacaccaacagctccacccggggcgtctactaccccgacaaggtgttccgcagctccatcctccacctgacccaggacctgttcctccccttcttcagcaacgtgacgtggttcaacaccatcacctaccagggcgggtccaagaagttcgacaacccggtcctgcccttcaacgacggggtgtacttcgccagcaccgagaagtccaacatcatccggggctggatcttcggcacgaccctggacgcccgcacccagagcctcctgatcgtgaacaacgcgaccaacgtcgtgatcaaggtgtgcgagttccagttctgcacggaccccttcctgggggtctactaccacaacaacaacaagacctgggtggagaacgagttccgggtgtactccagcgccaacaactgcaccttcgagtacatctcccagcccttcctcatggacctggagggcaagcaggggaacttcaagaacctgcgcgagttcgtcttcaagaacgtggacggctacttcaagatctacagcaagcacaccccgatcgacctcgtgcgggacctgccccgcgggttcgccgccctggagcccctcgtcgacctgcccatcggcatcaacatcacgcggttccagaccctgctcgccctgcaccgctcctacctgaccccgggcaagctcgagagcgggtggaccacgggcgcggccgcctactacgtggggtacctgcagcagcggaccttcctgctctcctacaaccagaacggcaccatcaccgacgccgtggactgcagcctggaccccctgtccgagacgaagtgcaccctcaagagcctgaccgtcgagaagggcatctaccagaccagcaacttccgcgtgcagcccacgatctccatcgtgcggttccccaacatcaccaacctgtgcccgttcggggaggtcttcaacgcgagcaagttcgcctccgtgtacgcctggaaccgcaagcggatcagcaactgcgtcgccgactactccgtgctctacaacagcacctccttcagcaccttcaagtgctacggcgtgtcccccacgaagctgaacgacctgtgcttcaccaacgtctacgccgacagcttcgtggtgaagggggacgaggtccgccagatcgcgcccggccagaccggggtgatcgccgactacaactacaagctccccgacgacttcaccggctgcgtgatcgcctggaactccgtcaagcaggacgccctgacgggcgacaactacgggtacctgtaccggctgttccgcaagagcaagctcaagccgttcgagcgggacatctccaccgagatctaccaggccggcagcaccccctgcaacggccaggtggggctgaactgctactaccccctcgagcgctacgggttccaccccaccaccggcgtgaactaccagccgttccgggtcgtggtgctgtccttcgagctgctcaacggccccgcgacggtctgcgggcccaagctgagcaccaccctggtgaaggacaagtgcgtgaacttcaacttcaacggcctgaccgggacgggcgtcctcaccacctccaagaagcagttcctgcccttccagcagttcgggcgcgacatcagcgacaccacggacgccgtgcgcgacccgcagaccctggagatcctcgacatcaccccctgctccttcggcggcgtgagcgtcatcacccccgggacgaacaccagcaaccaggtggccgtgctgtaccaggacgtcaactgcaccgaggtgccgatggccatccacgccgagcagctgacccccgcgtggcgggtgtactccgccggcgccaacgtcttccagacgcgcgccgggtgcctcgtgggcgccgagcacgtgaacaacagctacgagtgcgacatccccgtcggcgcggggatctgcgcctcctaccacagcatgtccagcttccggtccgtgaaccagcgcagcatcatcgcctacaccatgtccctgggcgccgagaacagcgtggcgtactccaacaacagcatcgccatccccaccaacttcaccatctccgtcacgaccgagatcctgccggtgagcatgaccaagacctccgtggactgcacgatgtacatctgcggggacagcatcgagtgctccaacctcctgctgcagtacggcagcttctgcacccagctcaaccgggccctgaccgggatcgccgtcgagcaggacaagaacacccaggaggtgttcgcccaggtgaagcagatctacaagacgccgcccatcaaggacttcggcggcttcaacttcagccagatcctgcccgacccctccaagcccagcaagcgctccttcatcgaggacctcctgttcaacaaggtcaccctggcggacgccgggttcatcaagcagtacggcgactgcctcggggacatcgccgcccgggacctgatctgcgcccagaagttcaacggcctgaccgtgctcccgcccctgctgaccgacgagatgatcgcgcagtacacgagcgccctcctggccgggaccatcacctccggctggaccttcggcgccggggccgcgctgcagatccccttcgccatgcagatggcctaccgcttcaacggcatcggggtgacgcagaacgtcctctacgagaaccagaagctgatcgccaaccagttcaacagcgcgatcggcaagatccaggactccctgagctccaccgccagcgccctcgggaagctgcaggacgtggtgaaccagaacgcccaggccctgaacaccctcgtcaagcagctgtccagcaacttcggcgcgatctccagcgtgctgaacgacatcctctcccggctggacaaggtggaggccgaggtccagatcgaccgcctgatcaccggccggctccagagcctgcagacctacgtgacgcagcagctgatccgcgccgccgagatccgggcctccgcgaacctcgccgccaccaagatgagcgagtgcgtgctggggcagtccaagcgcgtcgacttctgcggcaaggggtaccacctgatgagcttcccccagagcgcgccccacggcgtggtcttcctccacgtgacctacgtgcccgcccaggagaagaacttcaccacggccccggccatctgccacgaggggaaggcccacttcccccgggagggcgtcttcgtgtccaacggcacccactggttcatcacccagcgcaacttctacgagccccagatcatcaccacggacaacaccttcgtgagcgggtcctgcgacgtcgtgatcggcatcgtgaacaacaccgtctacgaccccctgcagccggagctggacagcttcaaggaggagctcgacaagtacttcaagaaccacacctcccccgacgtggacctgggggacatcagcggcatcaacgcctccgtggtcaacatccagaaggagatcgaccggctgaacgaggtggcgaagaacctcaacgagagcctgatcgacctgcaggagctcggcaagtacgagcagtacatcaagtggccctggtacatctggctggggttcatcgccggcctgatcgccatcatcatggtgacgatcatgctctgctgcatgacctcctgctgcagctgcctgaaggggtgctgctcctgcggcagctgctgcaagttcgacgaggacgactccgagcccgtcctgaagggggtgaagctccactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12809 - RNA, 4015 nt, synthetic construct
  misc_feature 1..4015: note = SARS-CoV-2/pangolin/Guangxi/P1E/2017__EPI_ISL_410539 spike protein mRNA gc (1-1265)
  source 1..4015: mol_type = other RNA
aggagaaagcttaccatgttcgtgttcctgttcgtcctccccctggtgagctcccagtgcgtgaacctgaccacccgcacgggcatccagccggggtacaccaacagctccacccggggcgtctactaccccgacaaggtgttccgcagctccatcctccacctgacccaggacctgttcctccccttcttcagcaacgtgacgtggttcaacaccatcaactaccagggcgggttcaagaagttcgacaaccccgtcctgccgttcaacgacggggtgtacttcgcctccaccgagaagtccaacatcatccggggctggatcttcggcaccacgctggacgcccgcacccagagcctcctgatcgtgaacaacgcgaccaacgtcgtgatcaaggtgtgcgagttccagttctgcaccgaccccttcctgggggtctactaccacaacaacaacaagacgtgggtggagaacgagttccgggtgtacagctccgccaacaactgcaccttcgagtacatcagccagcccttcctcatggacctggagggcaagcaggggaacttcaagaacctgcgcgagttcgtcttcaagaacgtggacggctacttcaagatctactccaagcacacccccatcgacctcgtgcgggacctgccgcgcgggttcgccgccctggagcccctcgtcgacctgcccatcggcatcaacatcacccggttccagacgctgctcgccctgcaccgcagctacctgacccccggcaagctcgagtccgggtggaccaccggcgcggccgcctactacgtggggtacctgcagcagcggacgttcctgctcagctacaaccagaacggcaccatcaccgacgccgtggactgctccctggacccgctgagcgagaccaagtgcacgctcaagtccctgaccgtcgagaagggcatctaccagaccagcaacttccgcgtgcagcccaccatcagcatcgtgcggttccccaacatcacgaacctgtgccccttcggggaggtcttcaacgcgtccaagttcgccagcgtgtacgcctggaaccgcaagcggatctccaactgcgtcgccgactacagcgtgctctacaactccaccagcttctccaccttcaagtgctacggcgtgagcccgaccaagctgaacgacctgtgcttcacgaacgtctacgccgactccttcgtggtgaagggggacgaggtccgccagatcgcgcccggccagaccggggtgatcgccgactacaactacaagctccccgacgacttcaccggctgcgtgatcgcctggaacagcgtcaagcaggacgccctgaccggcgggaactacctgtaccgcctcttccggaagtccaagctgaagcccttcgagcgggacatcagcacggagatctaccaggccggctccaccccgtgcaacggccaggtggggctgaactgctactaccccctcgagcgctacgggttccaccccaccaccggcgtgaactaccagcccttccgggtcgtggtgctgagcttcgagctgctcaacggcccggcgaccgtctgcgggcccaagctgtccacgaccctggtgaaggacaagtgcgtgaacttcaacttcaacggcctgaccgggaccggcgtcctcacgaccagcaagaagcagttcctgcccttccagcagttcgggcgcgacatctccgacaccaccgacgccgtgcgcgacccccagacgctggagatcctcgacatcaccccgtgcagcttcggcggcgtgtccgtcatcacccccgggaccaacacgagcaaccaggtggccgtgctgtaccaggacgtcaactgcaccgaggtgcccatggccatccacgccgagcagctgaccccggcgtggcgggtgtacagcgccggcgccaacgtcttccagacccgcgccgggtgcctcgtgggcgccgagcacgtgaacaactcctacgagtgcgacatccccgtcggcgcggggatctgcgccagctaccactccatgagctccctgcggagcgtgaaccagcgctccatcatcgcctacacgatgagcctgggcgccgagaactccgtggcgtacagcaacaactccatcgccatccccaccaacttcaccatcagcgtcaccacggagatcctccccgtgtccatgaccaagaccagcgtggactgcaccatgtacatctgcggggactccatcgagtgcagcaacctgctgctccagtacggctccttctgcacgcagctgaaccgggccctgaccgggatcgccgtcgagcaggacaagaacacccaggaggtgttcgcccaggtgaagcagatctacaagaccccgcccatcaaggacttcggcggcttcaacttcagccagatcctccccgaccccagcaagccgtccaagcgcagcttcatcgaggacctgctgttcaacaaggtcacgctcgcggacgccgggttcatcaagcagtacggcgactgcctgggggacatcgccgcccgggacctgatctgcgcccagaagttcaacggcctcaccgtgctgccgcccctgctcaccgacgagatgatcgcgcagtacacctccgccctgctggccgggacgatcaccagcggctggaccttcggcgccggggccgcgctccagatccccttcgccatgcagatggcctaccgcttcaacggcatcggggtgacccagaacgtcctgtacgagaaccagaagctgatcgccaaccagttcaactccgcgatcggcaagatccaggacagcctctccagcacggcctccgccctggggaagctgcaggacgtggtgaaccagaacgcccaggccctcaacaccctggtcaagcagctgagctccaacttcggcgcgatcagctccgtgctcaacgacatcctgagccggctggacaaggtggaggccgaggtccagatcgaccgcctcatcaccggccggctgcagtccctgcagacctacgtgacccagcagctcatccgcgccgccgagatccgggccagcgcgaacctggccgccacgaagatgtccgagtgcgtgctggggcagagcaagcgcgtcgacttctgcggcaaggggtaccacctcatgtccttcccccagagcgcgccccacggcgtggtcttcctgcacgtgacctacgtgcccgcccaggagaagaacttcaccaccgcccccgccatctgccacgaggggaaggcccacttcccgcgggagggcgtcttcgtgagcaacggcacgcactggttcatcacccagcgcaacttctacgagccccagatcatcaccaccgacaacacgttcgtgtccgggagctgcgacgtcgtgatcggcatcgtgaacaacaccgtctacgaccccctgcagcccgagctcgactccttcaaggaggagctggacaagtacttcaagaaccacaccagcccggacgtggacctgggggacatctccggcatcaacgccagcgtggtcaacatccagaaggagatcgaccggctcaacgaggtggcgaagaacctgaacgagtccctgatcgacctccaggagctgggcaagtacgagcagtacatcaagtggccctggtacatctggctggggttcatcgccggcctcatcgccatcatcatggtgaccatcatgctgtgctgcatgacgagctgctgctcctgcctgaaggggtgctgcagctgcggctcctgctgcaagttcgacgaggacgacagcgagcccgtcctcaagggggtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12810 - RNA, 4039 nt, synthetic construct; identical to SEQ ID NO: 163
  misc_feature 1..4039: note = SARS-CoV-2/Wuhan/WIV05/2019__EPI_ISL_402128 spike protein mRNA gc (1-1273)(K986P_V987P) R9515, R10157
  source 1..4039: mol_type = other RNA

SEQ ID NO: 12811 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_T887WN_A1020W) R9641
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12812 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_P1069F) R9660
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12813 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_ H1048Q_H1064N_ H1083N_H1101N) R9661
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12814 - RNA, 4039 nt, synthetic construct
  misc_feature 1..4039: note = SARS-CoV-2/Wuhan/WIV05/2019__EPI_ISL_402128 spike protein mRNA gc (1-1273)(I712C_T1077C)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12815 - RNA, 4039 nt, synthetic construct
  misc_feature 1..4039: note = SARS-CoV-2/Wuhan/WIV05/2019__EPI_ISL_402128 spike protein mRNA gc (1-1273)(I714C_Y1110C)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12816 - RNA, 4039 nt, synthetic construct
  misc_feature 1..4039: note = SARS-CoV-2/Wuhan/WIV05/2019__EPI_ISL_402128 spike protein mRNA gc (1-1273)(P715C_P1069C) R9561
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12817 - RNA, 4039 nt, synthetic construct
  misc_feature 1..4039: note = SARS-CoV-2/Wuhan/WIV05/2019__EPI_ISL_402128 spike protein mRNA gc (1-1273)(G889C_L1034C) R9564
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12818 - RNA, 4039 nt, synthetic construct
  misc_feature 1..4039: note = SARS-CoV-2/Wuhan/WIV05/2019__EPI_ISL_402128 spike protein mRNA gc (1-1273)(I909C_Y1047C)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12819 - RNA, 4039 nt, synthetic construct
  misc_feature 1..4039: note = SARS-CoV-2/Wuhan/WIV05/2019__EPI_ISL_402128 spike protein mRNA gc (1-1273)(Q965C_S1003C)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12820 - RNA, 4039 nt, synthetic construct
  misc_feature 1..4039: note = SARS-CoV-2/Wuhan/WIV05/2019__EPI_ISL_402128 spike protein mRNA gc (1-1273)(F970C_G999C) R9562
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12821 - RNA, 4039 nt, synthetic construct
  misc_feature 1..4039: note = SARS-CoV-2/Wuhan/WIV05/2019__EPI_ISL_402128 spike protein mRNA gc (1-1273)(A972C_R995C)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12822 - RNA, 4039 nt, synthetic construct
  misc_feature 1..4039: note = SARS-CoV-2/Wuhan/WIV05/2019__EPI_ISL_402128 spike protein mRNA gc (1-1273)(A890C_V1040C) R9560
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12823 - RNA, 4039 nt, synthetic construct
  misc_feature 1..4039: note = SARS-CoV-2/Wuhan/WIV05/2019__EPI_ISL_402128 spike protein mRNA gc (1-1273)(T874C_S1055C) R9563
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12824 - RNA, 2263 nt, synthetic construct; identical to SEQ ID NO: 166
  misc_feature 1..2263: note = SARS-CoV-2/Wuhan/WIV05/2019__EPI_ISL_402128 spike protein mRNA gc (1-681) R9506, R9513
  source 1..2263: mol_type = other RNA

SEQ ID NO: 12825 - RNA, 4333 nt, synthetic construct
  misc_feature 1..4333: note = SARS-CoV-2/Wuhan/WIV05/2019__EPI_ISL_402128 spike protein mRNA gc (1-1211) LumSynth construct
  source 1..4333: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12826 - RNA, 4333 nt, synthetic construct
  misc_feature 1..4333: note = SARS-CoV-2/Wuhan/WIV05/2019__EPI_ISL_402128 spike protein mRNA gc (1-1211)(K986P_V987P) LumSynth construct
  source 1..4333: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12827 - RNA, 4333 nt, synthetic construct
  misc_feature 1..4333: note = SARS-CoV-2/Wuhan/WIV05/2019__EPI_ISL_402128 spike protein mRNA gc (1-1211)(K986P_V987P_T887WN_A1020W) LumSynth construct
  source 1..4333: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12828 - RNA, 4333 nt, synthetic construct
  misc_feature 1..4333: note = SARS-CoV-2/Wuhan/WIV05/2019__EPI_ISL_402128 spike protein mRNA gc (1-1211)(K986P_V987P_P1069F) LumSynth construct
  source 1..4333: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12829 - RNA, 4333 nt, synthetic construct
  misc_feature 1..4333: note = SARS-CoV-2/Wuhan/WIV05/2019__EPI_ISL_402128 spike protein mRNA gc (1-1211)(K986P_V987P_ H1048Q_H1064N_ H1083N_H1101N) LumSynth construct
  source 1..4333: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12830 - RNA, 4333 nt, synthetic construct
  misc_feature 1..4333: note = SARS-CoV-2/Wuhan/WIV05/2019__EPI_ISL_402128 spike protein mRNA gc (1-1211)(I712C_T1077C) LumSynth construct
  source 1..4333: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12831 - RNA, 4333 nt, synthetic construct
  misc_feature 1..4333: note = SARS-CoV-2/Wuhan/WIV05/2019__EPI_ISL_402128 spike protein mRNA gc (1-1211)(I714C_Y1110C) LumSynth construct
  source 1..4333: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12832 - RNA, 4333 nt, synthetic construct
  misc_feature 1..4333: note = SARS-CoV-2/Wuhan/WIV05/2019__EPI_ISL_402128 spike protein mRNA gc (1-1211)(P715C_P1069C) LumSynth construct
  source 1..4333: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12833 - RNA, 4333 nt, synthetic construct
  misc_feature 1..4333: note = SARS-CoV-2/Wuhan/WIV05/2019__EPI_ISL_402128 spike protein mRNA gc (1-1211)(G889C_L1034C) LumSynth construct
  source 1..4333: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12834 - RNA, 4333 nt, synthetic construct
  misc_feature 1..4333: note = SARS-CoV-2/Wuhan/WIV05/2019__EPI_ISL_402128 spike protein mRNA gc (1-1211)(I909C_Y1047C) LumSynth construct
  source 1..4333: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12835 - RNA, 4333 nt, synthetic construct
  misc_feature 1..4333: note = SARS-CoV-2/Wuhan/WIV05/2019__EPI_ISL_402128 spike protein mRNA gc (1-1211)(Q965C_S1003C) LumSynth construct
  source 1..4333: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12836 - RNA, 4333 nt, synthetic construct
  misc_feature 1..4333: note = SARS-CoV-2/Wuhan/WIV05/2019__EPI_ISL_402128 spike protein mRNA gc (1-1211)(F970C_G999C) LumSynth construct
  source 1..4333: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12837 - RNA, 4333 nt, synthetic construct
  misc_feature 1..4333: note = SARS-CoV-2/Wuhan/WIV05/2019__EPI_ISL_402128 spike protein mRNA gc (1-1211)(A972C_R995C) LumSynth construct
  source 1..4333: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12838 - RNA, 4333 nt, synthetic construct
  misc_feature 1..4333: note = SARS-CoV-2/Wuhan/WIV05/2019__EPI_ISL_402128 spike protein mRNA gc (1-1211)(A890C_V1040C) LumSynth construct
  source 1..4333: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12839 - RNA, 4333 nt, synthetic construct
  misc_feature 1..4333: note = SARS-CoV-2/Wuhan/WIV05/2019__EPI_ISL_402128 spike protein mRNA gc (1-1211)(T874C_S1055C) LumSynth construct
  source 1..4333: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12840 - RNA, 4357 nt, synthetic construct
  misc_feature 1..4357: note = SARS-CoV-2/Wuhan/WIV05/2019__EPI_ISL_402128 spike protein mRNA gc (1-1211) Ferritin construct
  source 1..4357: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12841 - RNA, 4357 nt, synthetic construct
  misc_feature 1..4357: note = SARS-CoV-2/Wuhan/WIV05/2019__EPI_ISL_402128 spike protein mRNA gc (1-1211)(K986P_V987P) Ferritin construct
  source 1..4357: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12842 - RNA, 4357 nt, synthetic construct
  misc_feature 1..4357: note = SARS-CoV-2/Wuhan/WIV05/2019__EPI_ISL_402128 spike protein mRNA gc (1-1211)(K986P_V987P_T887WN_A1020W) Ferritin construct
  source 1..4357: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12843 - RNA, 4357 nt, synthetic construct
  misc_feature 1..4357: note = SARS-CoV-2/Wuhan/WIV05/2019__EPI_ISL_402128 spike protein mRNA gc (1-1211)(K986P_V987P_P1069F) Ferritin construct
  source 1..4357: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12844 - RNA, 4357 nt, synthetic construct
  misc_feature 1..4357: note = SARS-CoV-2/Wuhan/WIV05/2019__EPI_ISL_402128 spike protein mRNA gc (1-1211)(K986P_V987P_ H1048Q_H1064N_ H1083N_H1101N) Ferritin construct
  source 1..4357: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12845 - RNA, 4357 nt, synthetic construct
  misc_feature 1..4357: note = SARS-CoV-2/Wuhan/WIV05/2019__EPI_ISL_402128 spike protein mRNA gc (1-1211)(I712C_T1077C) Ferritin construct
  source 1..4357: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12846 - RNA, 4357 nt, synthetic construct
  misc_feature 1..4357: note = SARS-CoV-2/Wuhan/WIV05/2019__EPI_ISL_402128 spike protein mRNA gc (1-1211)(I714C_Y1110C) Ferritin construct
  source 1..4357: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12847 - RNA, 4357 nt, synthetic construct
  misc_feature 1..4357: note = SARS-CoV-2/Wuhan/WIV05/2019__EPI_ISL_402128 spike protein mRNA gc (1-1211)(P715C_P1069C) Ferritin construct
  source 1..4357: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12848 - RNA, 4357 nt, synthetic construct
  misc_feature 1..4357: note = SARS-CoV-2/Wuhan/WIV05/2019__EPI_ISL_402128 spike protein mRNA gc (1-1211)(G889C_L1034C) Ferritin construct
  source 1..4357: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12849 - RNA, 4357 nt, synthetic construct
  misc_feature 1..4357: note = SARS-CoV-2/Wuhan/WIV05/2019__EPI_ISL_402128 spike protein mRNA gc (1-1211)(I909C_Y1047C) Ferritin construct
  source 1..4357: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12850 - RNA, 4357 nt, synthetic construct
  misc_feature 1..4357: note = SARS-CoV-2/Wuhan/WIV05/2019__EPI_ISL_402128 spike protein mRNA gc (1-1211)(Q965C_S1003C) Ferritin construct
  source 1..4357: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12851 - RNA, 4357 nt, synthetic construct
  misc_feature 1..4357: note = SARS-CoV-2/Wuhan/WIV05/2019__EPI_ISL_402128 spike protein mRNA gc (1-1211)(F970C_G999C) Ferritin construct
  source 1..4357: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12852 - RNA, 4357 nt, synthetic construct
  misc_feature 1..4357: note = SARS-CoV-2/Wuhan/WIV05/2019__EPI_ISL_402128 spike protein mRNA gc (1-1211)(A972C_R995C) Ferritin construct
  source 1..4357: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12853 - RNA, 4357 nt, synthetic construct
  misc_feature 1..4357: note = SARS-CoV-2/Wuhan/WIV05/2019__EPI_ISL_402128 spike protein mRNA gc (1-1211)(A890C_V1040C) Ferritin construct
  source 1..4357: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12854 - RNA, 4357 nt, synthetic construct
  misc_feature 1..4357: note = SARS-CoV-2/Wuhan/WIV05/2019__EPI_ISL_402128 spike protein mRNA gc (1-1211)(T874C_S1055C) Ferritin construct
  source 1..4357: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12855 - RNA, 3943 nt, synthetic construct
  misc_feature 1..3943: note = SARS-CoV-2/Wuhan/WIV05/2019__EPI_ISL_402128 spike protein mRNA gc (1-1211) Foldon construct
  source 1..3943: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12856 - RNA, 3943 nt, synthetic construct
  misc_feature 1..3943: note = SARS-CoV-2/Wuhan/WIV05/2019__EPI_ISL_402128 spike protein mRNA gc (1-1211)(K986P_V987P) Foldon construct
  source 1..3943: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12857 - RNA, 3943 nt, synthetic construct
  misc_feature 1..3943: note = SARS-CoV-2/Wuhan/WIV05/2019__EPI_ISL_402128 spike protein mRNA gc (1-1211)(K986P_V987P_T887WN_A1020W) Foldon construct
  source 1..3943: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12858 - RNA, 3943 nt, synthetic construct
  misc_feature 1..3943: note = SARS-CoV-2/Wuhan/WIV05/2019__EPI_ISL_402128 spike protein mRNA gc (1-1211)(K986P_V987P_P1069F) Foldon construct
  source 1..3943: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12859 - RNA, 3943 nt, synthetic construct
  misc_feature 1..3943: note = SARS-CoV-2/Wuhan/WIV05/2019__EPI_ISL_402128 spike protein mRNA gc (1-1211)(K986P_V987P_ H1048Q_H1064N_ H1083N_H1101N) Foldon construct
  source 1..3943: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12860 - RNA, 3943 nt, synthetic construct
  misc_feature 1..3943: note = SARS-CoV-2/Wuhan/WIV05/2019__EPI_ISL_402128 spike protein mRNA gc (1-1211)(I712C_T1077C) Foldon construct
  source 1..3943: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12861 - RNA, 3943 nt, synthetic construct
  misc_feature 1..3943: note = SARS-CoV-2/Wuhan/WIV05/2019__EPI_ISL_402128 spike protein mRNA gc (1-1211)(I714C_Y1110C) Foldon construct
  source 1..3943: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12862 - RNA, 3943 nt, synthetic construct
  misc_feature 1..3943: note = SARS-CoV-2/Wuhan/WIV05/2019__EPI_ISL_402128 spike protein mRNA gc (1-1211)(P715C_P1069C) Foldon construct
  source 1..3943: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12863 - RNA, 3943 nt, synthetic construct
  misc_feature 1..3943: note = SARS-CoV-2/Wuhan/WIV05/2019__EPI_ISL_402128 spike protein mRNA gc (1-1211)(G889C_L1034C) Foldon construct
  source 1..3943: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12864 - RNA, 3943 nt, synthetic construct
  misc_feature 1..3943: note = SARS-CoV-2/Wuhan/WIV05/2019__EPI_ISL_402128 spike protein mRNA gc (1-1211)(I909C_Y1047C) Foldon construct
  source 1..3943: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12865 - RNA, 3943 nt, synthetic construct
  misc_feature 1..3943: note = SARS-CoV-2/Wuhan/WIV05/2019__EPI_ISL_402128 spike protein mRNA gc (1-1211)(Q965C_S1003C) Foldon construct
  source 1..3943: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12866 - RNA, 3943 nt, synthetic construct
  misc_feature 1..3943: note = SARS-CoV-2/Wuhan/WIV05/2019__EPI_ISL_402128 spike protein mRNA gc (1-1211)(F970C_G999C) Foldon construct
  source 1..3943: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12867 - RNA, 3943 nt, synthetic construct
  misc_feature 1..3943: note = SARS-CoV-2/Wuhan/WIV05/2019__EPI_ISL_402128 spike protein mRNA gc (1-1211)(A972C_R995C) Foldon construct
  source 1..3943: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12868 - RNA, 3943 nt, synthetic construct
  misc_feature 1..3943: note = SARS-CoV-2/Wuhan/WIV05/2019__EPI_ISL_402128 spike protein mRNA gc (1-1211)(A890C_V1040C) Foldon construct
  source 1..3943: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12869 - RNA, 3943 nt, synthetic construct
  misc_feature 1..3943: note = SARS-CoV-2/Wuhan/WIV05/2019__EPI_ISL_402128 spike protein mRNA gc (1-1211)(T874C_S1055C) Foldon construct
  source 1..3943: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12870 - RNA, 4315 nt, synthetic construct
  misc_feature 1..4315: note = SARS-CoV-2/Wuhan/WIV05/2019__EPI_ISL_402128 spike protein mRNA gc (1-1211) WhcAg construct
  source 1..4315: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12871 - RNA, 4315 nt, synthetic construct
  misc_feature 1..4315: note = SARS-CoV-2/Wuhan/WIV05/2019__EPI_ISL_402128 spike protein mRNA gc (1-1211)(K986P_V987P) WhcAg construct
  source 1..4315: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12872 - RNA, 4315 nt, synthetic construct
  misc_feature 1..4315: note = SARS-CoV-2/Wuhan/WIV05/2019__EPI_ISL_402128 spike protein mRNA gc (1-1211)(K986P_V987P_T887WN_A1020W) WhcAg construct
  source 1..4315: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12873 - RNA, 4315 nt, synthetic construct
  misc_feature 1..4315: note = SARS-CoV-2/Wuhan/WIV05/2019__EPI_ISL_402128 spike protein mRNA gc (1-1211)(K986P_V987P_P1069F) WhcAg construct
  source 1..4315: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12874 - RNA, 4315 nt, synthetic construct
  misc_feature 1..4315: note = SARS-CoV-2/Wuhan/WIV05/2019__EPI_ISL_402128 spike protein mRNA gc (1-1211)(K986P_V987P_ H1048Q_H1064N_ H1083N_H1101N) WhcAg construct
  source 1..4315: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12875 - RNA, 4315 nt, synthetic construct
  misc_feature 1..4315: note = SARS-CoV-2/Wuhan/WIV05/2019__EPI_ISL_402128 spike protein mRNA gc (1-1211)(I712C_T1077C) WhcAg construct
  source 1..4315: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12876 - RNA, 4315 nt, synthetic construct
  misc_feature 1..4315: note = SARS-CoV-2/Wuhan/WIV05/2019__EPI_ISL_402128 spike protein mRNA gc (1-1211)(I714C_Y1110C) WhcAg construct
  source 1..4315: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12877 - RNA, 4315 nt, synthetic construct
  misc_feature 1..4315: note = SARS-CoV-2/Wuhan/WIV05/2019__EPI_ISL_402128 spike protein mRNA gc (1-1211)(P715C_P1069C) WhcAg construct
  source 1..4315: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12878 - RNA, 4315 nt, synthetic construct
  misc_feature 1..4315: note = SARS-CoV-2/Wuhan/WIV05/2019__EPI_ISL_402128 spike protein mRNA gc (1-1211)(G889C_L1034C) WhcAg construct
  source 1..4315: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12879 - RNA, 4315 nt, synthetic construct
  misc_feature 1..4315: note = SARS-CoV-2/Wuhan/WIV05/2019__EPI_ISL_402128 spike protein mRNA gc (1-1211)(I909C_Y1047C) WhcAg construct
  source 1..4315: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12880 - RNA, 4315 nt, synthetic construct
  misc_feature 1..4315: note = SARS-CoV-2/Wuhan/WIV05/2019__EPI_ISL_402128 spike protein mRNA gc (1-1211)(Q965C_S1003C) WhcAg construct
  source 1..4315: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12881 - RNA, 4315 nt, synthetic construct
  misc_feature 1..4315: note = SARS-CoV-2/Wuhan/WIV05/2019__EPI_ISL_402128 spike protein mRNA gc (1-1211)(F970C_G999C) WhcAg construct
  source 1..4315: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12882 - RNA, 4315 nt, synthetic construct
  misc_feature 1..4315: note = SARS-CoV-2/Wuhan/WIV05/2019__EPI_ISL_402128 spike protein mRNA gc (1-1211)(A972C_R995C) WhcAg construct
  source 1..4315: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12883 - RNA, 4315 nt, synthetic construct
  misc_feature 1..4315: note = SARS-CoV-2/Wuhan/WIV05/2019__EPI_ISL_402128 spike protein mRNA gc (1-1211)(A890C_V1040C) WhcAg construct
  source 1..4315: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12884 - RNA, 4315 nt, synthetic construct
  misc_feature 1..4315: note = SARS-CoV-2/Wuhan/WIV05/2019__EPI_ISL_402128 spike protein mRNA gc (1-1211)(T874C_S1055C) WhcAg construct
  source 1..4315: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12885 - RNA, 4141 nt, synthetic construct
  misc_feature 1..4141: note = SARS-CoV-2/Wuhan/WIV05/2019__EPI_ISL_402128 spike protein mRNA gc (1-1147) LumSynth construct
  source 1..4141: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12886 - RNA, 4141 nt, synthetic construct
  misc_feature 1..4141: note = SARS-CoV-2/Wuhan/WIV05/2019__EPI_ISL_402128 spike protein mRNA gc (1-1147)(K986P_V987P) LumSynth construct
  source 1..4141: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12887 - RNA, 4141 nt, synthetic construct
  misc_feature 1..4141: note = SARS-CoV-2/Wuhan/WIV05/2019__EPI_ISL_402128 spike protein mRNA gc (1-1147)(K986P_V987P_T887WN_A1020W) LumSynth construct
  source 1..4141: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12888 - RNA, 4141 nt, synthetic construct
  misc_feature 1..4141: note = SARS-CoV-2/Wuhan/WIV05/2019__EPI_ISL_402128 spike protein mRNA gc (1-1147)(K986P_V987P_P1069F) LumSynth construct
  source 1..4141: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12889 - RNA, 4141 nt, synthetic construct
  misc_feature 1..4141: note = SARS-CoV-2/Wuhan/WIV05/2019__EPI_ISL_402128 spike protein mRNA gc (1-1147)(K986P_V987P_ H1048Q_H1064N_ H1083N_H1101N) LumSynth construct
  source 1..4141: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12890 - RNA, 4141 nt, synthetic construct
  misc_feature 1..4141: note = SARS-CoV-2/Wuhan/WIV05/2019__EPI_ISL_402128 spike protein mRNA gc (1-1147)(I712C_T1077C) LumSynth construct
  source 1..4141: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12891 - RNA, 4141 nt, synthetic construct
  misc_feature 1..4141: note = SARS-CoV-2/Wuhan/WIV05/2019__EPI_ISL_402128 spike protein mRNA gc (1-1147)(I714C_Y1110C) LumSynth construct
  source 1..4141: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12892 - RNA, 4141 nt, synthetic construct
  misc_feature 1..4141: note = SARS-CoV-2/Wuhan/WIV05/2019__EPI_ISL_402128 spike protein mRNA gc (1-1147)(P715C_P1069C) LumSynth construct
  source 1..4141: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12893 - RNA, 4141 nt, synthetic construct
  misc_feature 1..4141: note = SARS-CoV-2/Wuhan/WIV05/2019__EPI_ISL_402128 spike protein mRNA gc (1-1147)(G889C_L1034C) LumSynth construct
  source 1..4141: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12894 - RNA, 4141 nt, synthetic construct
  misc_feature 1..4141: note = SARS-CoV-2/Wuhan/WIV05/2019__EPI_ISL_402128 spike protein mRNA gc (1-1147)(I909C_Y1047C) LumSynth construct
  source 1..4141: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12895 - RNA, 4141 nt, synthetic construct
  misc_feature 1..4141: note = SARS-CoV-2/Wuhan/WIV05/2019__EPI_ISL_402128 spike protein mRNA gc (1-1147)(Q965C_S1003C) LumSynth construct
  source 1..4141: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12896 - RNA, 4141 nt, synthetic construct
  misc_feature 1..4141: note = SARS-CoV-2/Wuhan/WIV05/2019__EPI_ISL_402128 spike protein mRNA gc (1-1147)(F970C_G999C) LumSynth construct
  source 1..4141: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12897 - RNA, 4141 nt, synthetic construct
  misc_feature 1..4141: note = SARS-CoV-2/Wuhan/WIV05/2019__EPI_ISL_402128 spike protein mRNA gc (1-1147)(A972C_R995C) LumSynth construct
  source 1..4141: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12898 - RNA, 4141 nt, synthetic construct
  misc_feature 1..4141: note = SARS-CoV-2/Wuhan/WIV05/2019__EPI_ISL_402128 spike protein mRNA gc (1-1147)(A890C_V1040C) LumSynth construct
  source 1..4141: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12899 - RNA, 4141 nt, synthetic construct
  misc_feature 1..4141: note = SARS-CoV-2/Wuhan/WIV05/2019__EPI_ISL_402128 spike protein mRNA gc (1-1147)(T874C_S1055C) LumSynth construct
  source 1..4141: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12900 - RNA, 4165 nt, synthetic construct
  misc_feature 1..4165: note = SARS-CoV-2/Wuhan/WIV05/2019__EPI_ISL_402128 spike protein mRNA gc (1-1147) Ferritin construct
  source 1..4165: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12901 - RNA, 4165 nt, synthetic construct
  misc_feature 1..4165: note = SARS-CoV-2/Wuhan/WIV05/2019__EPI_ISL_402128 spike protein mRNA gc (1-1147)(K986P_V987P) Ferritin construct R9664
  source 1..4165: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12902 - RNA, 4165 nt, synthetic construct
  misc_feature 1..4165: note = SARS-CoV-2/Wuhan/WIV05/2019__EPI_ISL_402128 spike protein mRNA gc (1-1147)(K986P_V987P_T887WN_A1020W) Ferritin construct
  source 1..4165: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12903 - RNA, 4165 nt, synthetic construct
  misc_feature 1..4165: note = SARS-CoV-2/Wuhan/WIV05/2019__EPI_ISL_402128 spike protein mRNA gc (1-1147)(K986P_V987P_P1069F) Ferritin construct
  source 1..4165: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12904 - RNA, 4165 nt, synthetic construct
  misc_feature 1..4165: note = SARS-CoV-2/Wuhan/WIV05/2019__EPI_ISL_402128 spike protein mRNA gc (1-1147)(K986P_V987P_ H1048Q_H1064N_ H1083N_H1101N) Ferritin construct
  source 1..4165: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12905 - RNA, 4165 nt, synthetic construct
  misc_feature 1..4165: note = SARS-CoV-2/Wuhan/WIV05/2019__EPI_ISL_402128 spike protein mRNA gc (1-1147)(I712C_T1077C) Ferritin construct
  source 1..4165: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12906 - RNA, 4165 nt, synthetic construct
  misc_feature 1..4165: note = SARS-CoV-2/Wuhan/WIV05/2019__EPI_ISL_402128 spike protein mRNA gc (1-1147)(I714C_Y1110C) Ferritin construct
  source 1..4165: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12907 - RNA, 4165 nt, synthetic construct
  misc_feature 1..4165: note = SARS-CoV-2/Wuhan/WIV05/2019__EPI_ISL_402128 spike protein mRNA gc (1-1147)(P715C_P1069C) Ferritin construct
  source 1..4165: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12908 - RNA, 4165 nt, synthetic construct
  misc_feature 1..4165: note = SARS-CoV-2/Wuhan/WIV05/2019__EPI_ISL_402128 spike protein mRNA gc (1-1147)(G889C_L1034C) Ferritin construct
  source 1..4165: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12909 - RNA, 4165 nt, synthetic construct
  misc_feature 1..4165: note = SARS-CoV-2/Wuhan/WIV05/2019__EPI_ISL_402128 spike protein mRNA gc (1-1147)(I909C_Y1047C) Ferritin construct
  source 1..4165: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12910 - RNA, 4165 nt, synthetic construct
  misc_feature 1..4165: note = SARS-CoV-2/Wuhan/WIV05/2019__EPI_ISL_402128 spike protein mRNA gc (1-1147)(Q965C_S1003C) Ferritin construct
  source 1..4165: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12911 - RNA, 4165 nt, synthetic construct
  misc_feature 1..4165: note = SARS-CoV-2/Wuhan/WIV05/2019__EPI_ISL_402128 spike protein mRNA gc (1-1147)(F970C_G999C) Ferritin construct
  source 1..4165: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12912 - RNA, 4165 nt, synthetic construct
  misc_feature 1..4165: note = SARS-CoV-2/Wuhan/WIV05/2019__EPI_ISL_402128 spike protein mRNA gc (1-1147)(A972C_R995C) Ferritin construct
  source 1..4165: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12913 - RNA, 4165 nt, synthetic construct
  misc_feature 1..4165: note = SARS-CoV-2/Wuhan/WIV05/2019__EPI_ISL_402128 spike protein mRNA gc (1-1147)(A890C_V1040C) Ferritin construct
  source 1..4165: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12914 - RNA, 4165 nt, synthetic construct
  misc_feature 1..4165: note = SARS-CoV-2/Wuhan/WIV05/2019__EPI_ISL_402128 spike protein mRNA gc (1-1147)(T874C_S1055C) Ferritin construct
  source 1..4165: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12915 - RNA, 3751 nt, synthetic construct
  misc_feature 1..3751: note = SARS-CoV-2/Wuhan/WIV05/2019__EPI_ISL_402128 spike protein mRNA gc (1-1147) Foldon construct
  source 1..3751: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12916 - RNA, 3751 nt, synthetic construct
  misc_feature 1..3751: note = SARS-CoV-2/Wuhan/WIV05/2019__EPI_ISL_402128 spike protein mRNA gc (1-1147)(K986P_V987P) Foldon construct
  source 1..3751: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12917 - RNA, 3751 nt, synthetic construct
  misc_feature 1..3751: note = SARS-CoV-2/Wuhan/WIV05/2019__EPI_ISL_402128 spike protein mRNA gc (1-1147)(K986P_V987P_T887WN_A1020W) Foldon construct
  source 1..3751: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12918 - RNA, 3751 nt, synthetic construct
  misc_feature 1..3751: note = SARS-CoV-2/Wuhan/WIV05/2019__EPI_ISL_402128 spike protein mRNA gc (1-1147)(K986P_V987P_P1069F) Foldon construct
  source 1..3751: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12919 - RNA, 3751 nt, synthetic construct
  misc_feature 1..3751: note = SARS-CoV-2/Wuhan/WIV05/2019__EPI_ISL_402128 spike protein mRNA gc (1-1147)(K986P_V987P_ H1048Q_H1064N_ H1083N_H1101N) Foldon construct
  source 1..3751: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12920 - RNA, 3751 nt, synthetic construct
  misc_feature 1..3751: note = SARS-CoV-2/Wuhan/WIV05/2019__EPI_ISL_402128 spike protein mRNA gc (1-1147)(I712C_T1077C) Foldon construct
  source 1..3751: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12921 - RNA, 3751 nt, synthetic construct
  misc_feature 1..3751: note = SARS-CoV-2/Wuhan/WIV05/2019__EPI_ISL_402128 spike protein mRNA gc (1-1147)(I714C_Y1110C) Foldon construct
  source 1..3751: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12922 - RNA, 3751 nt, synthetic construct
  misc_feature 1..3751: note = SARS-CoV-2/Wuhan/WIV05/2019__EPI_ISL_402128 spike protein mRNA gc (1-1147)(P715C_P1069C) Foldon construct
  source 1..3751: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12923 - RNA, 3751 nt, synthetic construct
  misc_feature 1..3751: note = SARS-CoV-2/Wuhan/WIV05/2019__EPI_ISL_402128 spike protein mRNA gc (1-1147)(G889C_L1034C) Foldon construct
  source 1..3751: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12924 - RNA, 3751 nt, synthetic construct
  misc_feature 1..3751: note = SARS-CoV-2/Wuhan/WIV05/2019__EPI_ISL_402128 spike protein mRNA gc (1-1147)(I909C_Y1047C) Foldon construct
  source 1..3751: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12925 - RNA, 3751 nt, synthetic construct
  misc_feature 1..3751: note = SARS-CoV-2/Wuhan/WIV05/2019__EPI_ISL_402128 spike protein mRNA gc (1-1147)(Q965C_S1003C) Foldon construct
  source 1..3751: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12926 - RNA, 3751 nt, synthetic construct
  misc_feature 1..3751: note = SARS-CoV-2/Wuhan/WIV05/2019__EPI_ISL_402128 spike protein mRNA gc (1-1147)(F970C_G999C) Foldon construct
  source 1..3751: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12927 - RNA, 3751 nt, synthetic construct
  misc_feature 1..3751: note = SARS-CoV-2/Wuhan/WIV05/2019__EPI_ISL_402128 spike protein mRNA gc (1-1147)(A972C_R995C) Foldon construct
  source 1..3751: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12928 - RNA, 3751 nt, synthetic construct
  misc_feature 1..3751: note = SARS-CoV-2/Wuhan/WIV05/2019__EPI_ISL_402128 spike protein mRNA gc (1-1147)(A890C_V1040C) Foldon construct
  source 1..3751: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12929 - RNA, 3751 nt, synthetic construct
  misc_feature 1..3751: note = SARS-CoV-2/Wuhan/WIV05/2019__EPI_ISL_402128 spike protein mRNA gc (1-1147)(T874C_S1055C) Foldon construct
  source 1..3751: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12930 - RNA, 4123 nt, synthetic construct
  misc_feature 1..4123: note = SARS-CoV-2/Wuhan/WIV05/2019__EPI_ISL_402128 spike protein mRNA gc (1-1147) WhcAg construct
  source 1..4123: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12931 - RNA, 4123 nt, synthetic construct
  misc_feature 1..4123: note = SARS-CoV-2/Wuhan/WIV05/2019__EPI_ISL_402128 spike protein mRNA gc (1-1147)(K986P_V987P) WhcAg construct R9663
  source 1..4123: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12932 - RNA, 4123 nt, synthetic construct
  misc_feature 1..4123: note = SARS-CoV-2/Wuhan/WIV05/2019__EPI_ISL_402128 spike protein mRNA gc (1-1147)(K986P_V987P_T887WN_A1020W) WhcAg construct
  source 1..4123: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12933 - RNA, 4123 nt, synthetic construct
  misc_feature 1..4123: note = SARS-CoV-2/Wuhan/WIV05/2019__EPI_ISL_402128 spike protein mRNA gc (1-1147)(K986P_V987P_P1069F) WhcAg construct
  source 1..4123: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12934 - RNA, 4123 nt, synthetic construct
  misc_feature 1..4123: note = SARS-CoV-2/Wuhan/WIV05/2019__EPI_ISL_402128 spike protein mRNA gc (1-1147)(K986P_V987P_ H1048Q_H1064N_ H1083N_H1101N) WhcAg construct
  source 1..4123: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12935 - RNA, 4123 nt, synthetic construct
  misc_feature 1..4123: note = SARS-CoV-2/Wuhan/WIV05/2019__EPI_ISL_402128 spike protein mRNA gc (1-1147)(I712C_T1077C) WhcAg construct
  source 1..4123: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12936 - RNA, 4123 nt, synthetic construct
  misc_feature 1..4123: note = SARS-CoV-2/Wuhan/WIV05/2019__EPI_ISL_402128 spike protein mRNA gc (1-1147)(I714C_Y1110C) WhcAg construct
  source 1..4123: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12937 - RNA, 4123 nt, synthetic construct
  misc_feature 1..4123: note = SARS-CoV-2/Wuhan/WIV05/2019__EPI_ISL_402128 spike protein mRNA gc (1-1147)(P715C_P1069C) WhcAg construct
  source 1..4123: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12938 - RNA, 4123 nt, synthetic construct
  misc_feature 1..4123: note = SARS-CoV-2/Wuhan/WIV05/2019__EPI_ISL_402128 spike protein mRNA gc (1-1147)(G889C_L1034C) WhcAg construct
  source 1..4123: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12939 - RNA, 4123 nt, synthetic construct
  misc_feature 1..4123: note = SARS-CoV-2/Wuhan/WIV05/2019__EPI_ISL_402128 spike protein mRNA gc (1-1147)(I909C_Y1047C) WhcAg construct
  source 1..4123: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12940 - RNA, 4123 nt, synthetic construct
  misc_feature 1..4123: note = SARS-CoV-2/Wuhan/WIV05/2019__EPI_ISL_402128 spike protein mRNA gc (1-1147)(Q965C_S1003C) WhcAg construct
  source 1..4123: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12941 - RNA, 4123 nt, synthetic construct
  misc_feature 1..4123: note = SARS-CoV-2/Wuhan/WIV05/2019__EPI_ISL_402128 spike protein mRNA gc (1-1147)(F970C_G999C) WhcAg construct
  source 1..4123: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12942 - RNA, 4123 nt, synthetic construct
  misc_feature 1..4123: note = SARS-CoV-2/Wuhan/WIV05/2019__EPI_ISL_402128 spike protein mRNA gc (1-1147)(A972C_R995C) WhcAg construct
  source 1..4123: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12943 - RNA, 4123 nt, synthetic construct
  misc_feature 1..4123: note = SARS-CoV-2/Wuhan/WIV05/2019__EPI_ISL_402128 spike protein mRNA gc (1-1147)(A890C_V1040C) WhcAg construct
  source 1..4123: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12944 - RNA, 4123 nt, synthetic construct
  misc_feature 1..4123: note = SARS-CoV-2/Wuhan/WIV05/2019__EPI_ISL_402128 spike protein mRNA gc (1-1147)(T874C_S1055C) WhcAg construct
  source 1..4123: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12945 - RNA, 4039 nt, synthetic construct
  misc_feature 1..4039: note = SARS-CoV-2/Wuhan/WIV05/2019__EPI_ISL_402128 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcgttagcggcaattgtgatgtggtcatcgggatcgtgaacaatactgtatatgaccccctccaacctgagctggattccttcaaggaggaacttgacaaatactttaagaaccatacatcaccagatgtggacttgggagatattagtggcatcaatgccagcgtcgttaacattcagaaggaaatagaccgactgaatgaggtggctaaaaacttaaacgaatctctcatcgacctgcaggagcttggtaagtatgagcagtacattaaatggccctggtatatctggctggggttcattgcaggactaatcgccatagtgatggtcaccatcatgctctgctgtatgacttcctgctgttcatgcctgaagggctgttgcagttgtggtagctgctgcaaatttgatgaagacgattccgagcctgtgttgaagggcgttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12946 - RNA, 4027 nt, synthetic construct
  misc_feature 1..4027: note = SARS-CoV-2/bat/Yunnan/RaTG13/2013__EPI_ISL_402131 spike protein mRNA human (1-1269)
  source 1..4027: mol_type = other RNA
aggagaaagcttaccatgttcgtgtttctggtcctccttcccctggttagctcccagtgcgtgaacttgaccacaagaactcaattacctccagcctacaccaattcttcaacgaggggcgtatattacccggacaaggtgttccggagtagcgtcctgcacctaacacaggatctctttctgcccttcttttccaacgtgacttggttccatgctatccacgtttctgggaccaatggaattaaacgctttgacaaccctgtgcttccattcaatgatggtgtctattttgcatcgacagagaagtcaaacataatccgaggctggattttcgggaccactctggacagcaaaacacagagtttgctcatcgtgaataacgccaccaatgtagttattaaggtgtgtgaatttcagttctgcaacgatccctttctgggagtctactatcataaaaataacaagtcctggatggagtctgagttccgtgtgtacagctccgcgaataactgtacgttcgaatatgtgtcacaaccttttctgatggacctcgaaggcaagcagggtaatttcaaaaacttaagagagtttgtcttcaagaacatcgatgggtactttaaaatatacagtaagcacactccaatcaatctggttagggaccttccccctggattcagcgctttggagccactggtggatctaccgattggcatcaacattacccggtttcagacactcctggcccttcatcgctcttatctgactcccggcgactcctcaagcgggtggaccgcaggagccgctgcatactatgtaggttacttgcagcctagaacattcctcctgaaatataatgaaaacggcaccatcacggatgccgtggactgcgctttagatccactgagtgagactaagtgtacactcaagtcttttaccgtcgaaaaagggatataccaaacttccaatttcagggtgcagcccacagacagcattgttcggtttcctaacatcaccaatctttgcccattcggagaggtgtttaacgccacgaccttcgcgtcggtctatgcatggaatcgcaagcgaatttctaactgtgtggccgactactccgtactgtacaattcaacaagtttcagcacttttaaatgctatggcgtttcccccaccaagttgaacgatctatgtttcacaaatgtgtacgctgactcttttgtcatcactggtgatgaggtgagacagatcgccccggggcagaccggaaaaattgcagactataactacaagctgcctgatgacttcacaggctgcgtcatagcttggaatagcaaacacatcgatgccaaggaaggcgggaactttaactatctctacaggctgttccggaaggcgaatcttaaaccctttgagcgtgacatttcaaccgaaatctatcaagccggaagtaagccatgtaacggtcagactggcctgaattgctactaccctttgtatcgctacgggttctatcccacggatggagtgggccaccagccatacagagttgtggtactctcctttgagctgttaaacgcacccgctacagtctgcggtcctaaaaagagcaccaatctggtgaaaaacaagtgtgttaatttcaactttaatgggctaactggcaccggagtgctcacagaatctaacaagaaattcctgccatttcaacagttcggcagggacatagccgataccactgacgctgtccgggacccgcagacacttgagattttggatatcacgccctgctcattcgggggagtgagtgtaatcacccctggtactaatgccagcaaccaggtggcagttctgtatcaagacgtcaattgtacagaggtgccagtggccattcatgctgatcagctcacccccacatggcgagtctactccactggctctaacgtttttcagacccgcgcggggtgcctgatcggagcagaacacgtgaataactcgtatgagtgtgacattcctataggcgccggtatctgcgctagctaccagacgcaaaccaactccagatcagtggccagtcagtctattatcgcatacacaatgagccttggggccgaaaattccgtagcttattcaaacaatagcatcgccattccaactaacttcaccatatctgtcacaactgagatcctgcccgtgtccatgaccaagacgagtgttgattgtacaatgtacatttgcggcgacagcaccgaatgttctaatttgctcctgcagtatggatccttttgcactcagttaaacagggcactgacaggcatcgcggtggagcaagataaaaatacccaggaggtcttcgctcaggtgaagcagatttacaaaactccgcctatcaaggactttgggggattcaacttttcacaaatactaccagatcccagtaagcctagcaaacggtcgttcatcgaagacctcctgtttaataaggttacccttgccgatgcaggtttcattaaacagtatggcgactgtttgggggatatcgccgctcgcgacctgatttgcgcccagaagtttaacggactcacagtgctgcccccattactgacggacgagatgatcgcacaatacacctccgctcttttggccggcactataacatctggttggaccttcggggcgggcgccgctctccagattcctttcgcaatgcagatggcctatagatttaatggaatcggcgtaacacagaacgtcctgtacgaaaatcaaaaactaattgctaaccagttcaatagcgccatcgggaagatacaggattcactgagttccactgcatctgcgctcggaaagctgcaggacgtggtgaaccaaaacgcccaggctcttaataccttggtcaaacagctgagctccaactttggcgccatctcaagcgttttaaatgatattctcagtaggctggacaaggtggaggcagaagtacagatcgatcgtcttattacgggtcggctgcaatctttgcagacatacgtgacccagcaactcatccgagctgccgagataagagcatccgccaacctggctgcgactaaaatgagcgagtgcgtcctagggcagtcgaagagggtggacttctgtggaaaaggctatcatctgatgtcatttccccagtctgccccacacggtgttgtgttcctccacgtcacctacgtgccggcacaggaaaagaattttacaactgctcctgccatttgccatgatggcaaagcccacttcccccgcgagggggtttttgtgagtaacggaacccattggttcgtcacacaacggaatttttatgaaccacagatcatcacgaccgacaacactttcgtatccggcagctgtgatgtggttattgggatcgtgaataacacagtctacgaccccctgcagcctgagcttgattcttttaaggaggaattggacaagtatttcaaaaatcacaccagcccagatgtggacctgggagacatttccggcataaacgcttcagtagtgaatatccagaaggagattgatagattaaacgaagtcgccaaaaatctcaacgagagtctgatcgaccttcaagaactgggtaagtacgagcagtatattaaatggccctggtacatctggctagggttcatagcaggactcatcgcgattatcatggttactattatgctgtgctgtatgacaagctgctgttcttgcttgaagggctgttgctcctgtggttcatgctgcaagtttgatgaggacgatagtgaacctgtgctgaaaggcgtgaagttacattacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12947 - RNA, 4039 nt, synthetic construct
  misc_feature 1..4039: note = SARS-CoV-2/Wuhan/HBCDC-HB-01/2019__EPI_ISL_402132 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctatcaccaggggcgtatattacccggacaaggtgttccggtcaagtgtcctgcacagcacacaggatctatttctccccttcttttccaacgtgacttggttccatgctattcacgtttctgggaccaatggaacaaaacgctttgacaaccctgtgctgccattcaatgatggtgtctattttgcatcgaccgagaagtcaaacataatccgaggctggattttcgggactacacttgacagcaaaacccagagtctgttgatcgtgaataacgccacgaatgtagttattaaggtgtgtgaatttcagttctgcaacgatccctttctcggagtctactatcataaaaataacaagtcctggatggagtctgagttccgtgtgtacagctccgcgaataactgtactttcgagtatgtgtcacaaccttttctgatggacctggaaggcaagcagggtaatttcaaaaacctcagagagtttgtcttcaagaacatcgatgggtactttaaaatatacagtaagcacaccccaatcaatttagttagggacctgccccagggattcagcgctcttgagcctttggtggatctgccaattggcatcaacattacacggtttcagactctactcgccctgcatcgctcttatcttaccccgggcgactcctcaagcgggtggacagcaggagccgctgcatactatgtaggttacctgcaacccagaaccttcttgctcaaatataatgaaaacggcacgatcactgatgccgtggactgcgctctggatcctttaagtgagacaaagtgtaccctgaagtcttttactgtcgaaaaagggatataccagacatccaatttcagggtgcagccaaccgagagcattgttcggtttcccaacatcacgaatctctgccctttcggagaggtgtttaacgccacccgcttcgcgtcggtctatgcatggaatcgaaagagaatttctaactgtgtggccgactactccgtactttacaattcagctagtttcagcacatttaaatgctatggcgtttccccaactaagctgaacgacttgtgtttcaccaatgtgtacgccgattcttttgtcatcaggggtgacgaagtgcggcagatcgcacccgggcaaacaggaaaaattgctgattataactacaagctaccggacgatttcactggctgcgtcatagcctggaatagcaacaacctggactcaaaagtgggcgggaattataactacctctatcgtctgtttcgcaagagtaatcttaagcctttcgagagagatatctccaccgaaatttaccaggcgggaagcacaccctgtaacggtgttgagggctttaattgctacttcccactgcagtcttatgggtttcaacctaccaacggagtgggctaccagccctatagggtagtcgtgttgtcattcgaactcctgcacgccccagcaactgtttgcggtcccaaaaagagtacgaatttagtgaaaaacaagtgtgtcaattttaacttcaatgggctgacaggcaccggagtgctaactgagagcaacaaaaagtttctccctttccagcagttcggccgggacatcgctgataccacagacgccgtacgagatccacaaaccctggagatacttgacattactccgtgctcctttgggggagtgtctgttatcacacccggtacgaatacctcgaaccaggtcgctgtgttgtaccaggacgtgaattgtactgaagtccctgttgccatccacgcagatcagctgacaccaacctggcgcgtgtatagcacaggctccaacgtgttccaaactagagccgggtgcctcattggagctgagcatgtaaacaattcatacgaatgtgacatccccattggcgcgggtatatgcgcaagttatcagacccagacgaactctcctaggcgggcccgcagcgtcgcttcccagtcaatcattgcctacaccatgagcctgggggcagaaaattctgtggcctactccaacaatagtatcgctatcccaacaaactttactattagcgttaccacagaaatacttcccgtgtctatgactaagacctccgtcgattgtacgatgtatatctgcggcgactcaacagagtgtagtaatctgttgctccaatacggcagcttctgcacccagctgaacagagccttaactggaattgcagtggagcaggataaaaatacacaggaagtttttgcgcaagtgaagcagatctataaaaccccgcctattaaggacttcgggggatttaacttctcgcagatcctgccagatccctccaaaccttctaagaggagctttatagaggacctactcttcaataaggtaactctggctgatgccggttttatcaaacaatacggcgactgtcttggggatattgcagcccgtgacttgatctgcgctcagaagttcaacggactgaccgtcctgcccccactcttaacagatgaaatgattgcccagtatacgtcagcactgcttgctggcaccatcacgagtggttggacattcggggccggcgcggccttgcagataccttttgctatgcaaatggcataccggttcaatggaattggcgtgacccagaacgtgctctatgagaatcagaaactgatcgccaaccagtttaactccgctattgggaagatccaagactctctaagctccacagcctcagcactgggaaaactccaggacgtcgttaatcagaacgcgcaggccctgaatactcttgtgaagcaattgagcagtaacttcggcgctatatcttccgtactgaatgatatcttaagccgactcgacaaggtggaagccgaggtccagattgatagactgatcaccggtaggcttcagtcgctgcaaacgtacgtgacacagcagttgattcgcgcagctgagatccgggcctcagcaaacctcgccgctaccaaaatgtctgaatgcgttctggggcagagtaagagagtggacttttgtggaaaaggctaccacctaatgtccttcccccaaagcgcgccacatggtgtcgtgtttctgcacgttacttatgtgccggcccaggagaagaatttcaccacagctcctgcaatatgccacgatggcaaagcccattttcccagggaaggggtcttcgtatctaacggaactcactggtttgtgacccagcgcaatttctacgagccacagattatcacaacggacaacacctttgttagcggcaattgtgatgtggtcatcgggattgtgaacaatactgtatatgaccccctccaacctgagctggattccttcaaggaggaacttgacaaatacttcaagaaccatacatcaccagatgtggacttgggagatatcagtggcattaatgccagcgtcgttaacatacagaaggaaatcgaccgactgaatgaggtggctaaaaacttaaacgaatctctcattgacctgcaggagcttggtaagtatgagcagtacatcaaatggccctggtatatttggctggggtttatcgcaggactaatagccatcgtgatggtcaccattatgctctgctgtatgacttcctgctgttcatgcctgaagggctgttgcagttgtggtagctgctgcaaattcgatgaagacgattccgagcctgtgttgaagggcgttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12948 - RNA, 4039 nt, synthetic construct
  misc_feature 1..4039: note = SARS-CoV-2/Guangdong/20SF028/2020__EPI_ISL_403936 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgtatagcacacaggatctattcctcccctttttctccaacgtgacttggtttcacgctatccatgtttctgggaccaatggaacaaaacgcttcgacaaccctgtgctgccatttaatgatggtgtctacttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctattaccacaaaaataacaagtcctggatggagtctgagttccgtgtgtatagctccgcgaataactgtacttttgaatacgtgtcacaacctttcctgatggacctggaaggcaagcagggtaattttaaaaacctcagagagttcgtctttaagaacattgatgggtacttcaaaatctatagtaagcataccccaataaatttagttagggacctgccccagggatttagcgctcttgagcctttggtggatctgccaatcggcattaacatcacacggttccagactctactcgccctgcaccgctcttaccttaccccgggcgactcctcaagcgggtggacagcaggagccgctgcatattacgtaggttatctgcaacccagaacctttttgctcaaatacaatgaaaacggcacgattactgatgccgtggactgcgctctggatcctttaagtgagacaaagtgtaccctgaagtctttcactgtcgaaaaagggatctatcagacatccaattttagggtgcagccaaccgagagcatagttcggttccccaacattacgaatctctgcccttttggagaggtgttcaacgccacccgcttcgcgtcggtctacgcatggaatcgaaagagaatctctaactgtgtggccgactactccgtactttataattcagctagttttagcacattcaaatgctacggcgtttccccaactaagctgaacgacttgtgttttaccaatgtgtatgccgattctttcgtcattaggggtgacgaagtgcggcagatcgcacccgggcaaacaggaaaaatcgctgattacaactataagctaccggacgattttactggctgcgtcattgcctggaatagcaacaacctggactcaaaagtgggcgggaattacaactatctctaccgtctgttccgcaagagtaatcttaagccttttgagagagatatatccaccgaaatctaccaggcgggaagcacaccctgtaacggtgttgagggcttcaattgctattttccactgcagtcttacgggttccaacctaccaacggagtgggctatcagccctacagggtagtcgtgttgtcatttgaactcctgcatgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtatcaggacgtgaattgtactgaagtccctgttgccatccacgcagatcagctgacaccaacctggcgcgtgtacagcacaggctccaacgtgtttcaaactagagccgggtgcctcatcggagctgagcacgtaaacaattcatatgaatgtgacattcccatcggcgcgggtatttgcgcaagttaccagacccagacgaactctcctaggcgggcccgcagcgtcgcttcccagtcaataatcgcctacaccatgagcctgggggcagaaaattctgtggcctattccaacaatagtattgctatcccaacaaacttcactatcagcgttaccacagaaattcttcccgtgtctatgactaagacctccgtcgattgtacgatgtacatatgcggcgactcaacagagtgtagtaatctgttgctccaatatggcagcttttgcacccagctgaacagagccttaactggaatcgcagtggagcaggataaaaatacacaggaagttttcgcgcaagtgaagcagatttacaaaaccccgcctatcaaggactttgggggattcaacttttcgcagattctgccagatccctccaaaccttctaagaggagcttcatcgaggacctactctttaataaggtaactctggctgatgccggtttcataaaacaatatggcgactgtcttggggatatcgcagcccgtgacttgatttgcgctcagaagttcaacggactgaccgtcctgcccccactcttaacagatgaaatgatcgcccagtacacgtcagcactgcttgctggcaccattacgagtggttggacatttggggccggcgcggccttgcagatccctttcgctatgcaaatggcatatcggtttaatggaataggcgtgacccagaacgtgctctacgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctatcatctaatgtcctttccccaaagcgcgccacacggtgtcgtgttcctgcatgttacttacgtgccggcccaggagaagaattttaccacagctcctgcaatctgccacgatggcaaagcccacttccccagggaaggggtctttgtatctaacggaactcattggttcgtgacccagcgcaatttttatgagccacagataattacaacggacaacaccttcgttagcggcaattgtgatgtggtcatcgggatcgtgaacaatactgtatacgaccccctccaacctgagctggattccttcaaggaggaacttgacaaatattttaagaaccacacatcaccagatgtggacttgggagatattagtggcatcaatgccagcgtcgttaacattcagaaggaaatagaccgactgaatgaggtggctaaaaacttaaacgaatctctcatcgacctgcaggagcttggtaagtacgagcagtatattaaatggccctggtacatctggctggggttcattgcaggactaatcgccatagtgatggtcaccatcatgctctgctgtatgacttcctgctgttcatgcctgaagggctgttgcagttgtggtagctgctgcaaatttgatgaagacgattccgagcctgtgttgaagggcgttaagctgcattacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12949 - RNA, 4039 nt, synthetic construct
  misc_feature 1..4039: note = SARS-CoV-2/Shenzhen/SZTH-001/2020__EPI_ISL_406592 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcgttagcggcaattgtgatgtgctcatcgggatcgtcaacaatactgtgtatgaccccctgcaacctgagcttgattccttcaaggaagagttggacaaatactttaagaaccatacatcaccagatgtagacctgggagatattagtggcatcaatgccagcgtggtcaacattcagaaggaaatagaccgattaaatgaggttgctaaaaacctcaacgaatctctgatcgaccttcaggagctgggtaagtatgagcagtacattaaatggccctggtatatctggctagggttcattgcaggactcatcgccatagtgatggtgaccatcatgctgtgctgtatgacttcctgctgttcatgcttgaagggctgttgcagttgtggtagctgctgcaaatttgatgaagacgattccggccctgtcctgaagggggtgaagttacactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12950 - RNA, 4039 nt, synthetic construct
  misc_feature 1..4039: note = SARS-CoV-2/Shenzhen/SZTH-004/2020__EPI_ISL_406595 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacacgaatagcttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatgggaccgaaagagaatctctaattgtgtggcctactactccgtactttataactcagctagttttagcacattcaaatgctacggcgtttccccaactaagctgaatgacttgtgttttaccaacgtgtatgccgattctttcgtcattaggggtgacgaagtgcggcagatcgcacccgggcaaacaggaaaaatcgctgattacaattataagctaccggacgattttactggctgcgtcattgcctggaacagcaataacctggactcaaaagtgggcgggaactacaattatctctaccgtctgttccgcaagagtaaccttaagccttttgagagagatatatccaccgaaatctaccaggcgggaagcacaccctgtaatggtgttgagggcttcaactgctattttccactgcagtcttacgggttccaacctaccaatggagtgggctatcagccctacagggtagtcgtgttgtcatttgaactcctgcacgccccagcaactgtttgcggtcccaaaaagagtacgaacttagtgaaaaataagtgtgtcaacttcaattttaacgggctgacaggcaccggagtgctaactgagagcaataaaaagttcctccctttccagcagtttggccgggacattgctgataccacagacgccgtacgagatccacaaaccctggagatccttgacataactccgtgctccttcgggggagtgtctgttattacacccggtacgaacacctcgaatcaggtcgctgtgttgtatcaggacgtgaactgtactgaagtccctgttgccatccacgcagatcagctgacaccaacctggcgcgtgtacagcacaggctccaatgtgtttcaaactagagccgggtgcctcatcggagctgagcatgtaaacaactcatatgaatgtgacattcccatcggcgcgggtatttgcgcaagttaccagacccagactaattctcctaggcgggcccgcagcgtcgcttcccagtcaataatcgcctacaccatgagcctgggggcagagaactctgtggcctattccaataacagtattgctatcccaacaaatttcactatcagcgttaccacagaaattcttcccgtgtctatgactaagacctccgtcgattgtacgatgtacatatgcggcgactcaacagagtgtagtaacctgttgctccaatatggatctttttgcacccagctgaatagagccttaactggcatcgcagtggagcaggataaaaacacacaggaagttttcgcgcaagtgaagcagatttacaaaaccccgcctatcaaggactttgggggattcaatttttcgcagattctgccagatccctccaaaccttctaagaggagcttcatcgaggacctactctttaacaaggtaactctggctgatgccggtttcataaaacaatatggcgactgtcttggggatatcgcagcccgtgacttgatttgcgctcagaagttcaatggactgaccgtcctgcccccactcttaacagatgaaatgatcgcccagtacacgtcagcactgcttgctggcaccattacgagtggttggacatttggggccggcgcggccttgcagatccctttcgctatgcaaatggcatatcggtttaacggaataggcgtgacccagaatgtgctctacgagaaccagaaactgattgccaatcagttcaactccgctatcgggaagattcaagactctctaagctccacagcctcagcactgggaaaactccaggacgtcgttaaccagaatgcgcaggccctgaacactcttgtgaagcaattgagcagtaattttggcgctatctcttccgtactgaacgatatattaagccgactcgacaaggtggaagccgaggtccagatcgatagactgattaccggtaggcttcagtcgctgcaaacgtacgtgacacagcagttgatccgcgcagctgagattcgggcctcagcaaatctcgccgctaccaaaatgtctgaatgcgttctggggcagagtaagagagtggacttctgtggaaaaggctatcacctaatgtcctttccccaaagcgcgccacatggtgtcgtgttcctgcacgttacttacgtgccggcccaggagaagaactttaccacagctcctgcaatctgccacgatggcaaagcccatttccccagggaaggggtctttgtatctaatggaactcactggttcgtgacccagcgcaacttttatgagccacagataattacaacggacaataccttcgttagcggcaactgtgatgtggtcatcgggatcgtgaataacactgtatacgaccccctccaacctgagctggattccttcaaggaagaacttgacaaatattttaagaatcatacatcaccagatgtggacttgggagatattagtggcatcaacgccagcgtcgttaatattcagaaggaaatagaccgactgaacgaggtggctaaaaatttaaacgaatctctcatcgacctgcaggagcttggtaagtacgagcagtatattaaatggccctggtacatctggctggggttcattgcaggactaatcgccatagtgatggtcaccatcatgctctgctgtatgacttcctgctgttcatgcctgaagggctgttgcagttgtggtagctgctgcaaatttgatgaagacgattccgagcctgtgttgaagggcgttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12951 - RNA, 4039 nt, synthetic construct
  misc_feature 1..4039: note = SARS-CoV-2/France/IDF0372/2020__EPI_ISL_406596 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactcctttctttacaattcagctagtttcagcacatttaaatgctatggcgtatccccaactaagctgaacgacttgtgtttcaccaatgtttacgccgattcttttgtgattaggggtgacgaagtccggcagatcgcacccgggcaaacaggaaaaatcgctgattataactacaagctaccggacgatttcactggctgcgtgattgcctggaatagcaacaacctggactcaaaagtcggcgggaattataactacctctatcgtctgtttcgcaagagtaatcttaagcctttcgagagagatatatccaccgaaatctaccaggcgggaagcacaccctgtaacggtgtggagggctttaattgctacttcccactgcagtcttatgggtttcaacctaccaacggagttggctaccagccctatagggtggtagtcttgtcattcgaactcctgcacgccccagcaactgtgtgcggtcccaaaaagagtacgaatttagttaaaaacaagtgtgtgaattttaacttcaatgggctgacaggcaccggagtcctaactgagagcaacaaaaagttcctcccttttcagcagttcggccgggacattgctgataccacagacgccgtgcgagatccacaaaccctggagatccttgacataactccgtgctcctttgggggagtatctgtgattacacccggtacgaatacctcgaaccaggttgctgtcttgtaccaggacgtgaattgtactgaagtgcctgtcgccatccacgcagatcagctgacaccaacctggcgcgtttatagcacaggctccaacgtgttccaaactagagccgggtgcctcatcggagctgagcatgtgaacaattcatacgaatgtgacattcccatcggcgcgggtatttgcgcaagttatcagacccagacgaactctcctaggcgggcccgcagcgtagcttcccagtcaataatcgcctacaccatgagcctgggggcagaaaattctgtcgcctactccaacaatagtattgctatcccaacaaactttactatcagcgtgaccacagaaattcttcccgtttctatgactaagacctccgtggattgtacgatgtatatatgcggcgactcaacagagtgtagtaatctgttgctccaatacggcagcttctgcacccagctgaacagagccttaactggaatcgcagtcgagcaggataaaaatacacaggaagtgtttgcgcaagttaagcagatttataaaaccccgcctatcaaggacttcgggggatttaacttctcgcagattctgccagatccctccaaaccttctaagaggagctttatcgaggacctactcttcaataaggtgactctggctgatgccggtttcataaaacaatacggcgactgtcttggggatatcgcagcccgtgacttgatttgcgctcagaagtttaacggactgaccgtactgcccccactcttaacagatgaaatgatcgcccagtatacgtcagcactgcttgctggcaccattacgagtggttggacattcggggccggcgcggccttgcagatcccttttgctatgcaaatggcataccggttcaatggaataggcgtcacccagaacgtgctctatgagaatcagaaactgattgccaaccagtttaactccgctatcgggaagattcaagactctctaagctccacagcctcagcactgggaaaactccaggacgtggtcaatcagaacgcgcaggccctgaatactcttgttaagcaattgagcagtaacttcggcgctatctcttccgtgctgaatgatatattaagccgactcgacaaggtagaagccgaggtgcagatcgatagactgattaccggtaggcttcagtcgctgcaaacgtacgtcacacagcagttgatccgcgcagctgagattcgggcctcagcaaacctcgccgctaccaaaatgtctgaatgcgtgctggggcagagtaagagagttgacttttgtggaaaaggctaccacctaatgtccttcccccaaagcgcgccacatggtgtggtctttctgcacgtgacttatgttccggcccaggagaagaatttcaccacagctcctgcaatctgccacgatggcaaagcccattttcccagggaaggggtgttcgtctctaacggaactcactggtttgtaacccagcgcaatttctacgagccacagataattacaacggacaacaccttcgtgagcggcaattgtgatgttgtgatcgggatcgtcaacaatactgtgtatgaccccctccaacctgagctggattcctttaaggaggaacttgacaaatacttcaagaaccatacatcaccagatgtagacttgggagatattagtggcatcaatgccagcgtggtcaacattcagaaggaaatagaccgactgaatgaggttgctaaaaacttaaacgaatctctcatcgacctgcaggagcttggtaagtatgagcagtacattaaatggccctggtatatctggctggggtttattgcaggactaatcgccatagtgatggtgaccatcatgctctgctgtatgacttcctgctgttcatgcctgaagggctgttgcagttgtggtagctgctgcaaattcgatgaagacgattccgagcctgtcttgaagggcgtgaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12952 - RNA, 4039 nt, synthetic construct
  misc_feature 1..4039: note = SARS-CoV-2/Australia/VIC01/2020__EPI_ISL_406844 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacaccaattctttcacgaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgcagatatcttaccccgggcgactcttcctcagggtggacagcaggagccgctgcatactatgtaggttacctgcaacccaggacctttttgctcaaatataatgaaaacggcacgattactgatgccgtggactgcgctctggatcctttaagcgagacaaagtgtaccctgaagagtttcactgtcgaaaaagggatctaccagacatctaattttcgggtgcagccaaccgagtccatagttcgcttccccaacattacgaatctctgcccttttggagaggtgttcaacgccacccgattcgcgagcgtctatgcatggaatagaaagaggatctcgaactgtgtggccgactactctgtactttacaattccgcttcatttagtacattcaaatgctatggcgttagcccaactaagctgaacgacttgtgttttaccaatgtgtacgccgattccttcgtcattcggggtgacgaagtgcgtcagatcgcacccgggcaaacaggaaaaatcgctgattataactacaagctaccggacgattttactggctgcgtcattgcctggaactctaataacctggacagcaaagtgggcgggaattataactacctctatcgcctgttcagaaagtcaaatcttaagccttttgagagggatataagtaccgaaatctaccaggcgggatccacaccctgtaacggtgttgagggcttcaattgctactttccactgcagagctatgggttccaacctaccaacggagtgggctaccagccctatcgggtagtcgtgttgtcttttgaactcctgcacgccccagcaactgtttgcggtcccaaaaagtcaacgaatttagtgaaaaacaagtgtgtcaatttcaactttaatgggctgacaggcaccggagtgctaactgagagtaacaaaaagttcctccctttccagcagtttggccgagacattgctgataccacagacgccgtacgcgatccacaaaccctggagatccttgacataactccgtgcagcttcgggggagtgtccgttattacacccggtacgaatacctctaaccaggtcgctgtgttgtaccaggacgtgaattgtactgaagtccctgttgccatccacgcagatcagctgacaccaacctggagagtgtattcgacaggcagcaacgtgtttcaaactagggccgggtgcctcatcggagctgagcatgtaaacaattcctacgaatgtgacattcccatcggcgcgggtatttgcgcatcatatcagacccagacgaacagtcctcggcgcgccagatctgtcgctagccagtccataatcgcctacaccatgtcactgggggcagagaatagcgtggcctactctaacaattccattgctatcccaacaaacttcactatcagtgttaccacagaaattcttcccgtgagcatgactaagacctctgtcgattgtacgatgtatatatgcggcgactccacagagtgttcaaatctgttgctccaatacggaagtttttgcacccagctgaacagggccttaactggcatcgcagtggagcaggataaaaatacacaggaagttttcgcgcaagtgaagcagatttataaaaccccgcctatcaaggactttgggggattcaactttagccagattctgccagatccctcgaaaccttccaagcgttctttcatcgaggacctactctttaataaggtaactctggctgatgccggtttcataaaacaatacggcgactgtcttggggatatcgcagcccgggacttgatttgcgctcagaagttcaacggactgaccgtcctccctccactgttaacagatgaaatgatcgcccagtatacgagcgcactgcttgctggcaccattacttcaggttggacatttggggccggcgcggccttgcagatccctttcgctatgcaaatggcataccgatttaatggaataggcgtgacccagaacgtgctctatgagaatcagaaactgattgccaaccagttcaacagtgctatcgggaagattcaagactccctatctagcacagcctccgcactgggaaaactccaggacgtcgttaatcagaacgcgcaggccctgaatactcttgtgaagcaattgtcaagcaactttggcgctatcagttctgtactgaatgatatattatccagactcgacaaggtggaagccgaggtccagatcgataggctgattaccggtcgccttcagagcctgcaaacgtacgtgacacagcagttgatccgggcagctgagattagagcctcggcaaacctcgccgctaccaaaatgtcagaatgcgttctggggcagtctaagagggtggacttctgtggaaaaggctaccacctaatgagttttccccaatccgcgccacatggtgtcgtgttcctgcacgttacttatgtgccggcccaggagaagaattttaccacagcacccgctatctgccacgatggcaaagcccatttcccccgcgaaggggtctttgtaagcaacggaactcactggttcgtgacccagcgaaatttttacgagccacagataattacaacggacaacaccttcgtttctggcaattgtgatgtggtcatcgggatcgtgaacaatactgtatatgaccccctccaacctgagctggatagcttcaaggaagaacttgacaaatactttaagaaccatacatccccagatgtggacttgggagatatttcaggcatcaatgccagtgtcgttaacattcagaaggaaatagaccggctgaatgaggtggctaaaaacttaaacgaaagcctcatcgacctgcaggagcttggtaagtatgagcagtacattaaatggccctggtatatctggctggggttcattgcaggactaatcgccatagtgatggtcaccatcatgctctgctgtatgacttcttgctgttcctgcctgaagggctgttgctcatgtggtagttgctgcaaatttgatgaagacgatagcgagcctgtgttgaagggcgttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12953 - RNA, 4039 nt, synthetic construct
  misc_feature 1..4039: note = SARS-CoV-2/Germany/BavPat1/2020__EPI_ISL_406862 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctaagctccacagcctcagcactgggcaaactccaggacgtcgttaatcagaacgcgcaggccctgaatactcttgtgaagcaattgagcagtaactttggtgctatctcttccgtactgaatgacatattaagccgactcgataaggtggaagccgaggtccagatcgacagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggatttctgtggcaaaggttaccacctaatgtcctttccccaaagcgcgccacatggcgtcgtgttcctgcacgttacttatgtgccggcccaggagaagaattttaccacagctcctgcaatctgccacgacgggaaagcccatttccccagggaaggagtctttgtatctaacggcactcactggttcgtgacccagcgcaatttttacgagccacagataattacaacggataacaccttcgttagcgggaattgtgacgtggtcatcggaatcgtgaacaatactgtatatgatcccctccaacctgagctggactccttcaaggaagaacttgataaatactttaagaaccatacatcaccagacgtggatttgggcgacattagtggtatcaatgccagcgtcgttaacattcagaaggaaatagatcgactgaatgaggtggctaaaaacttaaacgaatctctcatcgacctgcaggagcttgggaagtatgagcagtacattaaatggccctggtatatctggctgggattcattgcaggcctaatcgccatagtgatggtcaccatcatgctctgctgtatgacttcctgctgttcatgcctgaagggttgttgcagttgtggcagctgctgcaaatttgacgaagatgactccgagcctgtgttgaagggggttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12954 - RNA, 4039 nt, synthetic construct
  misc_feature 1..4039: note = SARS-CoV-2/Wuhan/HBCDC-HB-02/2020__EPI_ISL_412978 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaattttctgttgcaatacggcagcttctgcacccagctcaacagagccctgactggaatcgcagtggagcaggataaaaatacacaggaagtttttgcgcaagtgaagcagatttataaaaccccgcctatcaaggacttcgggggatttaacttctcgcagattttaccagatccctccaaaccttctaagaggagctttatcgaggacctgctattcaataaggtaactctcgctgatgccggtttcataaaacaatacggcgactgtctgggggatatcgcagcccgtgaccttatttgcgctcagaagtttaacggattgaccgtcctgcccccactcctgacagatgaaatgatcgcccagtatacgtcagcattactggctggcaccattacgagtggttggacattcggggccggcgcggcccttcagatcccttttgctatgcaaatggcataccggttcaatggaataggcgtgacccagaacgtgttgtatgagaatcagaaactcattgccaaccagtttaactccgctatcgggaagattcaagactctctgagctccacagcctcagcactaggaaaactgcaggacgtcgttaatcagaacgcgcaggccctcaatactctggtgaagcaacttagcagtaacttcggcgctatctcttccgtattgaatgatatactgagccgattagacaaggtggaagccgaggtccagatcgatagactcattaccggtaggctgcagtcgcttcaaacgtacgtgacacagcagctgatccgcgcagctgagattcgggcctcagcaaacttggccgctaccaaaatgtctgaatgcgttctcgggcagagtaagagagtggacttttgtggaaaaggctaccacctgatgtccttcccccaaagcgcgccacatggtgtcgtgtttctacacgttacttatgtgccggcccaggagaagaatttcaccacagctcctgcaatctgccacgatggcaaagcccattttcccagggaaggggtcttcgtatctaacggaactcactggtttgtgacccagcgcaatttctacgagccacagataattacaacggacaacaccttcgttagcggcaattgtgatgtggtcatcgggatcgtgaacaatactgtatatgaccccctgcaacctgagctcgattcctttaaggaagaactggacaaatacttcaagaaccatacatcaccagatgtggaccttggagatattagtggcatcaatgccagcgtcgttaacattcagaaggaaatagaccgattgaatgaggtggctaaaaacctgaacgaatctttaatcgacctccaggagctgggtaagtatgagcagtacattaaatggccctggtatatctggcttgggtttattgcaggactgatcgccatagtgatggtcaccatcatgctatgctgtatgacttcctgctgttcatgcctcaagggctgttgcagttgtggtagctgctgcaaattcgatgaagacgattccgagcctgtgctgaagggcgttaagttgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12955 - RNA, 4039 nt, synthetic construct
  misc_feature 1..4039: note = SARS-CoV-2/Australia/QLD02/2020__EPI_ISL_407896 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcgttagcggcaattgtgatgtggtcatcgggatcgtgaacaatactgtatatgaccccctccaactggagcttgattccttcaaggaagagttggacaaatactttaagaaccatacatcacctgatgtggacctgggagatattagtggcatcaatgccagcgtcgttaacattcagaaggaaatagaccgattaaatgaggtggctaaaaacctcaacgaatctctgatcgaccttcaggagctgggtaagtatgagcagtacattaaatggccatggtatatctggctagggttcattgcaggactcatcgccatagtgatggtcaccatcatgctgtgctgtatgacttcctgctgttcatgcttgaagggctgttgcagttgtggtagctgctgcaaatttgatgaagacgattccgagcccgtgctgaagggcgttaagttacactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12956 - RNA, 4039 nt, synthetic construct
  misc_feature 1..4039: note = SARS-CoV-2/India/1-31/2020__EPI_ISL_413523 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgtcatcgggaagattcaagactctctaagctccacagcttcagccctgggaaaactccaggacgttgtgaatcagaacgcacaggcgctgaatactcttgtaaagcaattgagcagtaactttggcgccatctcttccgtgctgaatgatatattaagccgactcgacaaggtcgaagctgaggtgcagatcgatagactgattaccggtaggcttcagtcgctgcaaacgtacgttacacagcagttgatccgcgccgcagagattcgggcttcagccaacctcgcagccaccaaaatgtctgaatgcgtgctggggcagagtaagagagtcgacttctgtggaaaaggctaccacctaatgtcctttccccaaagcgctccacatggtgtggttttcctgcacgtgacttatgtcccggcgcaggagaagaattttaccacagcccctgcaatctgccacgatggcaaagctcatttccccagggaaggggtatttgtgtctaacggaactcactggttcgttacccagcgcaatttttacgagccacagataattacaacggacaacaccttcgtgagcggcaattgtgatgtcgtgatcgggatcgtaaacaatactgtgtatgaccccctccaacctgagctggattccttcaaggaggaacttgacaaatactttaagaaccatacatcaccagatgtcgacttgggagatattagtggcatcaatgccagcgttgtgaacattcagaaggaaatagaccgactgaatgaggtggccaaaaacttaaacgaatctctcatcgacctgcaggagcttggtaagtatgagcagtacattaaatggccctggtatatctggctggggttcattgctggactaatcgcaatagtcatggtgaccatcatgctctgctgtatgacttcctgctgttcatgcctgaagggctgttgcagttgtggtagctgctgcaaatttgatgaagacgattccgagcctgttttgaagggcgtaaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12957 - RNA, 4039 nt, synthetic construct
  misc_feature 1..4039: note SARS-CoV-2/Guangdong/GD2020087-P0008/2020__EPI_ISL_413863 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggaatctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcgggagatcgcacccgggcagacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgaaagagatatatccaccgagatctaccaagcgggaagcacaccctgtaacggtgttgaaggcttcaattgctactttccactgcagtcttatgggttccagcctaccaacggagtgggctaccaaccctatagggtagtcgtgttgtcatttgagctcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacagaccctggaaatccttgacataactccgtgctccttcgggggagtgtctgttattacacccggtacgaatacctcgaaccaagtcgctgtgttgtaccaggacgtgaattgtactgaggtccctgttgccatccacgcagatcagctgacaccaacctggcgcgtgtatagcacaggctccaacgtgtttcagactagagccgggtgcctcatcggagctgaacatgtaaacaattcatacgagtgtgacattcccatcggcgcgggtatttgcgcaagttatcaaacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagagattcttcccgtgtctatgactaagacctccgtcgattgtacgatgtatatatgcggcgactcaacagagtgtagtaatctgttgctccagtacggcagcttttgcacccaactgaacagagccttaactggaatcgcagtggaacaggataaaaatacacaggaggttttcgcacaggtgaagcaaatttataaaaccccgcctatcaaggactttgggggattcaacttttcgcagattctgccagatccctccaaaccttctaagaggagcttcatcgaagacctactctttaataaggtaactctggctgatgccggtttcataaaacagtacggcgactgtcttggggatatcgcagcccgtgacttgatttgcgctcaaaagttcaacggactgaccgtcctgcccccactcttaacagatgagatgatcgcccagtatacgtcagcactgcttgctggcaccattacgagtggttggacatttggggccggcgcggccttgcagatccctttcgctatgcagatggcataccggtttaatggaataggcgtgacccaaaacgtgctctatgaaaatcagaaactgattgccaaccagttcaactccgctatcgggaagattcaggactctctaagctccacagcctcagcactgggaaaactccaagacgtcgttaatcagaacgcgcaggccctgaatactcttgtgaagcagttgagcagtaactttggcgctatctcttccgtactgaatgatatattaagccgactcgacaaggtggaggccgaggtccaaatcgatagactgattaccggtaggcttcagtcgctgcagacgtacgtgacacaacagttgatccgcgcagctgaaattcgggcctcagcaaacctcgccgctaccaaaatgtctgagtgcgttctggggcagagtaagagagtggacttctgtggaaaaggctaccacctaatgtcctttccccagagcgcgccacatggtgtcgtgttcctgcacgttacttatgtgccggcccaagaaaagaattttaccacagcgcctgctatctgccacgatggcaaagcccatttccccagggagggggtctttgtatctaacggaactcactggttcgtgacccagcgcaatttttacgagccacagataattacaacggacaacaccttcgttagcggcaattgtgatgtggtcatcgggatcgtgaacaatactgtatatgaccccctccagcctgaactggattccttcaaggaggaacttgacaaatactttaagaaccatacatcaccagatgtggacttgggagatattagtggcatcaatgccagcgtcgttaacattcaaaaggagatagaccgactgaatgaagtggctaaaaacttaaacgagtctctcatcgacctgcaggagcttggtaagtatgaacagtacattaaatggccctggtatatctggctggggttcattgcaggactaatcgccatagtgatggtcaccatcatgctctgctgtatgacttcctgctgttcatgcctgaagggctgttgcagttgtggtagctgctgcaaatttgatgaggacgattccgaacctgtgttgaagggcgttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12958 - RNA, 4039 nt, synthetic construct
  misc_feature 1..4039: note = SARS-CoV-2/Sweden/01/2020__EPI_ISL_411951 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactgtgggggatttaacttctcgcagattctgccagatccctccaaaccttctaagaggagctttatcgaggacctactcttcaataaggtaactctggctgatgccggttttataaaacaatacggcgactgccttggggatatcgcagcccgtgacttgatttgcgctcagaagttcaacggactgaccgtcctgcccccactcttaacagatgaaatgatcgcccagtatacgtcagcactgcttgctggcaccattacgagtggttggacattcggggccggcgcggccttgcagatcccttttgctatgcaaatggcataccggttcaatggaataggcgtgacccagaacgtgctctatgagaatcagaaactgattgccaaccagtttaactccgctatcgggaagattcaagactctctaagctccacagcctcagcactgggaaaactccaggacgtcgttaatcagaacgcgcaggccctgaatactcttgtgaagcaattgagcagtaacttcggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgtgttctggggcagagtaagagagtggacttttgcggaaaaggctaccacctaatgtccttcccccaaagcgcgccacatggtgtcgtgtttctgcacgttacttatgtgccggcccaggagaagaatttcaccacagctcctgcaatctgtcacgatggcaaagcccattttcccagggaaggggtcttcgtatctaacggaactcactggtttgtgacccagcgcaatttctacgagccacagataattacaacggacaacacctttgttagcggcaattgcgatgtggtcatcgggatcgtgaacaatactgtatatgaccccctccaacctgagctggattccttcaaggaggaacttgacaaatacttcaagaaccatacatcaccagatgtggacttgggagatattagtggcatcaatgccagcgtcgttaacattcagaaggaaatagaccgactgaatgaggtggctaaaaacttaaacgaatctctcatcgacctgcaggagcttggtaagtatgagcagtacattaaatggccctggtatatctggctggggtttattgcaggactaatcgccatagtgatggtcaccatcatgctctgttgcatgacttcctgttgctcatgtctgaagggctgctgtagttgcggtagctgctgtaaattcgatgaagacgattccgagcctgtgttgaagggcgttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12959 - RNA, 4039 nt, synthetic construct
  misc_feature 1..4039: note = SARS-CoV-2/Tianmen/HBCDC-HB-07/2020__EPI_ISL_412983 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacctgaattgtactgaagtgcctgtcgccatccacgcagatcagctcacaccaacctggcgcgtttatagcacaggctccaacgtgtttcaaactagagccgggtgcctgatcggagctgagcatgtgaacaattcatacgaatgtgacattcccatcggcgcgggtatttgcgcaagttatcagacccagacgaactctcctaggcgggcccgcagcgtagcttcccagtcaataatcgcctacaccatgagccttggggcagaaaattctgtcgcctactccaacaatagtattgctatcccaacaaacttcactatcagcgtgaccacagaaattctgcccgtttctatgactaagacctccgtggattgtacgatgtatatatgcggcgactcaacagagtgtagtaatttgctcctgcaatacggcagcttttgcacccagttaaacagagccctgactggaatcgcagtcgagcaggataaaaatacacaggaagtgttcgcgcaagttaagcagatttataaaaccccgcctatcaaggactttgggggattcaacttttcgcagattctaccagatccctccaaaccttctaagaggagcttcatcgaggacctcctgtttaataaggtgactcttgctgatgccggtttcataaaacaatacggcgactgtttgggggatatcgcagcccgtgacctgatttgcgctcagaagttcaacggactcaccgtactgcccccattactgacagatgaaatgatcgcccagtatacgtcagcacttttggctggcaccattacgagtggttggacatttggggccggcgcggccctccagatccctttcgctatgcaaatggcataccggtttaatggaataggcgtcacccagaacgtgctgtatgagaatcagaaactaattgccaaccagttcaactccgctatcgggaagattcaagactctctgagctccacagcctcagcactcggaaaactgcaggacgtggtcaatcagaacgcgcaggcccttaatactttggttaagcaactgagcagtaactttggcgctatctcttccgtgttaaatgatatactcagccgactggacaaggtagaagccgaggtgcagatcgatagacttattaccggtaggctgcagtcgttgcaaacgtacgtcacacagcagctcatccgcgcagctgagattcgggcctcagcaaacctggccgctaccaaaatgtctgaatgcgtgctagggcagagtaagagagttgacttctgtggaaaaggctaccacctgatgtcctttccccaaagcgcgccacatggtgtggtcttcctccacgtgacttatgttccggcccaggagaagaattttaccacagctcctgcaatctgccacgatggcaaagcccatttccccagggaaggggtgtttgtctctaacggaactcactggttcgtaacccagcgcaatttttacgagccacagataattacaacggacaacaccttcgtgagcggcaattgtgatgttgtgatcgggatcgtcaacaatactgtgtatgaccccctgcaacctgagcttgattccttcaaggaagagttggacaaatactttaagaaccatacatcaccagatgtagacctgggagatattagtggcatcaatgccagcgtggtcaacattcagaaggaaatagaccgattaaatgaggttgctaaaaacctcaacgaatctctgatcgaccttcaggagctgggtaagtatgagcagtacattaaatggccctggtatatctggctagggttcattgcaggactcatcgccatagtgatggtgaccatcatgctgtgctgtatgacttcctgctgttcatgcttgaagggctgttgcagttgtggtagctgctgcaaatttgatgaagacgattccgagcctgtcctgaagggcgtgaagttacactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12960 - RNA, 4039 nt, synthetic construct
  misc_feature 1..4039: note = SARS-CoV-2/Hong Kong/case42_VM20002493/2020__EPI_ISL_414527 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacacgaatagcttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcgccatcagcgttactaccgaaattcttcccgtgtctatgacaaagacttccgtcgattgtaccatgtatatatgcggcgactcaacggagtgtagtaatctgttgctccaatacggatctttttgcacacagctgaacagagcattaaccggcatcgcggtggagcaggataaaaatactcaggaagttttcgctcaagtgaagcagatttataaaacaccgcctatcaaggactttgggggattcaacttttcgcagattctgccagatccctccaaaccttctaagaggagcttcatcgaggacctactctttaataaggtaaccctggccgatgcaggtttcataaaacaatacggcgactgtcttggggatatcgccgctcgtgacttgatttgcgcccagaagttcaacggactgactgtcctgcccccactcttaaccgatgaaatgatcgcacagtatacatcagctctgcttgccggcacgattaccagtggttggacttttggggcgggcgccgctttgcagatccctttcgcaatgcaaatggcctaccggtttaatggaataggcgtgacacagaacgtgctctatgagaatcagaaactgattgctaaccagttcaactccgccatcgggaagattcaagactctctaagctccaccgcatcagcgctgggaaaactccaggacgtcgttaatcagaacgcccaggctctgaatacacttgtgaagcaattgagcagtaactttggcgccatctcttccgtactgaatgatatattaagccgactcgacaaggtggaagcagaggtccagatcgatagactgattactggtaggcttcagtcgctgcaaacctacgtgacgcagcagttgatccgcgctgccgagattcgggcatcagccaacctcgctgcgacaaaaatgtctgaatgcgttctggggcagagtaagagagtggacttctgtggaaaaggctaccacctaatgtcctttccccaaagcgccccacatggtgtcgtgttcctgcacgttacctatgtgccggcacaggagaagaattttactaccgctcctgccatctgccacgatggcaaagcccatttccccagggaaggggtctttgtatctaacggaacacactggttcgtgactcagcgcaatttttacgagccacagataattaccacagacaacacgttcgttagcggcaattgtgatgtggtcatcgggatcgtgaacaataccgtatatgaccccctccaacctgagctggattccttcaaggaggaacttgacaaatactttaagaaccatacttcaccagatgtggacttgggagatattagtggcatcaatgctagcgtcgttaacattcagaaggaaatagaccgactgaatgaggtggccaaaaacttaaacgaatctctcatcgacctgcaggagcttggtaagtatgagcagtacattaaatggccctggtatatctggctggggttcattgcaggactaatcgcgatagtgatggtcacaatcatgctctgctgtatgacctcctgctgttcatgcctgaagggctgttgcagttgtggtagctgctgcaaatttgatgaagacgattccgagcctgtgttgaagggcgttaagctgcactacacttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12961 - RNA, 4039 nt, synthetic construct
  misc_feature 1..4039: note = SARS-CoV-2/USA/CruiseA-23/2020__EPI_ISL_414482 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaagtcaagcagggcaattttaaaaacctcagagagttcgtttttaagaacattgatggttacttcaaaatctacagtaagcacaccccaataaatttagtgagggacctgccccaggggtttagcgctcttgagcctttggtagatctgccaatcggaattaacatcacacggttccagactctactcgccctgcatcgctcttatcttaccccgggcgactcctcaagcggctggacagcaggggccgctgcatactatgtgggatacctgcaacccagaacctttttgctcaaatataatgaaaacggtacgattactgatgccgtcgactgcgctctggatcctttaagtgagacaaagtgtaccctgaagtctttcactgtggaaaaaggcatctaccagacatccaattttagggttcagccaaccgagagcatagtgcggttccccaacattacgaatctctgcccttttggggaggtcttcaacgccacccgcttcgcgtcggtgtatgcatggaatcgaaagagaatctctaactgtgtagccgactactccgttctttacaattcagctagttttagcacattcaaatgctatggagtgtccccaactaagctgaacgacttgtgttttaccaatgtctacgccgattctttcgtgattaggggcgacgaagtccggcagatcgcacccggtcaaacagggaaaatcgctgattataactacaagctaccggacgattttactggatgcgtgattgcctggaatagcaacaacctggactcaaaagttggcggcaattataactacctctatcgtctgttccgcaagagtaatcttaagccttttgagagagatatatccaccgaaatctaccaggcggggagcacaccctgtaacggagtggagggtttcaattgctactttccactgcagtcttatggcttccaacctaccaacggggtaggataccagccctatagggtcgtggttttgtcatttgaactcctgcacgccccagcaactgtgtgcggccccaaaaagagtacgaatttagtcaaaaacaagtgtgtgaatttcaactttaatggtctgacagggaccggcgtactaactgagagcaacaaaaagttcctccctttccagcagtttggacgggacattgctgataccacagacgccgtgcgagatccacaaaccctggagatccttgacataactccgtgctccttcggcggggtttctgtcattacacccggaacgaatacctcgaaccaggtggctgtgttgtaccaggacgtcaattgtactgaagttcctgtggccatccacgcagatcagctgacaccaacctggcgcgtgtatagcacaggttccaacgtatttcaaactagagccggctgcctcatcggggctgagcatgtcaacaattcatacgaatgtgacattcccatcggagcgggcatttgcgcaagttatcagacccagacgaactctcctaggcgggcccgcagcgtggcttcccagtcaataatcgcctacaccatgagcctgggtgcagaaaattctgttgcctactccaacaatagtattgctatcccaacaaacttcactatcagcgtgaccacagaaattcttcccgtctctatgactaagacctccgtggattgtacgatgtatatatgcggggactcaacagagtgtagtaatctgttgctccaatacggcagcttttgcacccagctgaacagagccttaactggaatcgcagttgagcaggataaaaatacacaggaagtgttcgcgcaagtaaagcagatttataaaaccccgcctatcaaggactttggcgggttcaacttttcgcagattctgccagatccctccaaaccttctaagaggagcttcatcgaggacctactctttaataaggtcactctggctgatgccggattcataaaacaatacggtgactgtcttggcgatatcgcagcccgtgacttgatttgcgctcagaagttcaacgggctgaccgtgctgcccccactcttaacagatgaaatgatcgcccagtatacgtcagcactgcttgctggaaccattacgagtggctggacatttggtgccggggcggccttgcagatccctttcgctatgcaaatggcataccggtttaatggcataggagtgacccagaacgtcctctatgagaatcagaaactgattgccaaccagttcaactccgctatcggcaagattcaagactctctaagctccacagcctcagcactggggaaactccaggacgttgtgaatcagaacgcgcaggccctgaatactcttgtaaagcaattgagcagtaactttggagctatctcttccgtgctgaatgatatattaagccgactcgacaaggtcgaagccgaggtgcagatcgatagactgattaccggcaggcttcagtcgctgcaaacgtacgttacacagcagttgatccgcgcagctgagattcgggcctcagcaaacctcgccgctaccaaaatgtctgaatgcgtgctgggtcagagtaagagagtcgacttctgtgggaaaggataccacctaatgtcctttccccaaagcgcgccacatggcgtggttttcctgcacgtgacttatgtcccggcccaggagaagaattttaccacagctcctgcaatctgccacgatggtaaagcccatttccccagggaaggcgtatttgtgtctaacgggactcactggttcgttacccagcgcaatttttacgagccacagataattacaacggacaacaccttcgtgagcggaaattgtgatgtcgtgatcggcatcgtaaacaatactgtgtatgaccccctccaacctgagctggattccttcaaggaagaacttgacaaatactttaagaaccatacatcaccagatgtcgacttgggggatattagtggaatcaatgccagcgttgtgaacattcagaaggaaatagaccgactgaatgaggtggctaaaaacttaaacgaatctctcatcgacctgcaggagcttggcaagtatgagcagtacattaaatggccctggtatatctggctgggtttcattgcagggctaatcgccatagtcatggtgaccatcatgctctgctgtatgacttcctgctgttcatgcctgaagggatgttgcagttgtggcagctgctgcaaatttgatgaagacgattccgagcctgttttgaagggtgtaaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12962 - RNA, 4039 nt, synthetic construct
  misc_feature 1..4039: note = SARS-CoV-2/Hong Kong/case85_VM20002868/2020__EPI_ISL_414519 spike protein mRNA human (1-1273)
  source 1..4039: mol_type = other RNA
aggagaaagcttaccatgttcgtgtttctggtcctcgttccccttgtgagctcccagtgcgtaaacctgaccacaagaactcaattgcctccagcctacactaattctttcaccaggggcgtgtattacccggacaaggtctttcggtcaagtgtgttacacagcacacaggatctgttcctaccctttttctccaacgttacttggtttcatgctatccacgtgtctgggaccaatggaacaaaacgcttcgacaaccctgtcctcccatttaatgatggtgtgtatttcgcatcgaccgagaagtcaaacattatacgaggctggatctttgggactacactggacagcaaaacccagagtcttctgattgtaaataacgccacgaatgttgtgatcaaggtctgtgagttccagttttgcaacgatcccttcttgggagtgtactatcataaaaataacaagtcctggatggagtctgagttccgtgtgtacagctccgcgaataactgtacttttgaatatgtctcacaacctttcctcatggacctggaaggcaagcagggtaattttaaaaacctgagagagttcgtttttaagaacattgatgggtacttcaaaatctacagtaagcacaccccaataaatctcgtgagggacttaccccagggatttagcgctctggagcctcttgtagatttgccaatcggcattaacatcacacggttccagactctgctagccctccatcgctcttatctgaccccgggcgactcctcaagcgggtggacagcaggagccgctgcatactatgtgggttaccttcaacccagaacctttctgttgaaatataatgaaaacggcacgattactgatgccgtcgactgcgctctcgatcctctgagtgagacaaagtgtaccttaaagtctttcactgtggaaaaagggatctaccagacatccaattttagggttcagccaaccgagagcatagtgcggttccccaacattacgaatctgtgcccttttggagaggtcttcaacgccacccgcttcgcgtcggtgtatgcatggaatcgaaagagaatctctaactgtgtagccgactactccgttctctacaattcagctagttttagcacattcaaatgctatggcgtgtccccaactaaacttaacgacctgtgttttaccaatgtctacgccgattctttcgtgattaggggtgacgaagtccggcagatcgcacccgggcaaacaggaaagatcgctgattataactacaagttgccggacgattttactggctgcgtgattgcctggaatagcaacaacctagactcaaaagttggcgggaattataactacctgtatcgtctcttccgcaagagtaatctgaagccttttgagagagatatatccaccgaaatctaccaggcgggaagcacaccctgtaacggtgtggagggcttcaattgctactttccacttcagtcttatgggttccaacctaccaacggagtaggctaccagccctatagggtcgtggttctgtcatttgaattgctccacgccccagcaactgtgtgcggtcccaaaaagagtacgaatctggtcaaaaacaagtgtgtgaatttcaactttaatgggttaacaggcaccggagtactgactgagagcaacaaaaagttcctacctttccagcagtttggccgggacattgctgataccacagacgccgtgcgagatccacaaaccctcgagatcctggacataactccgtgctccttcgggggagtttctgtcattacacccggtacgaatacctcgaaccaggtggctgtgctttaccaggacgtcaattgtactgaagttcctgtggccatccacgcagatcagttgacaccaacctggcgcgtgtatagcacaggctccaacgtatttcaaactagagccgggtgcctgatcggagctgagcatgtcaacaattcatacgaatgtgacattcccatcggcgcgggtatttgcgcaagttatcagacccagacgaactctcctaggcgggcccgcagcgtggcttcccagtcaataatcgcctacaccatgagcctcggggcagaaaattctgttgcctactccaacaatagtattgctatcccaacaaacttcactatcagcgtgaccacagaaattctgcccgtctctatgactaagacctccgtggattgtacgatgtatatatgcggcgactcaacagagtgtagtaatcttctgttgcaatacggcagcttttgcacccagctcaacagagccctgactggaatcgcagttgagcaggataaaaatacacaggaagtgttcgcgcaagtaaagcagatttataaaaccccgcctatcaaggactttgggggattcaacttttcgcagattttaccagatccctccaaaccttctaagaggagcttcatcgaggacctgctatttaataaggtcactctcgctgatgccggtttcataaaacaatacggcgactgtctgggggatatcgcagcccgtgaccttatttgcgctcagaagttcaacggattgaccgtgctgcccccactcctgacagatgaaatgatcgcccagtatacgtcagcattactggctggcaccattacgagtggttggacatttggggccggcgcggcccttcagatccctttcgctatgcaaatggcataccggtttaatggaataggcgtgacccagaacgtcttgtatgagaatcagaaactcattgccaaccagttcaactccgctatcgggaagattcaagactctctgagctccacagcctcagcactaggaaaactgcaggacgttgtgaatcagaacgcgcaggccctcaatactctggtaaagcaacttagcagtaactttggcgctatctcttccgtgttgaatgatatactgagccgattagacaaggtcgaagccgaggtgcagatcgatagactcattaccggtaggctgcagtcgcttcaaacgtacgttacacagcagctgatccgcgcagctgagattcgggcctcagcaaacttggccgctaccaaaatgtctgaatgcgtgctcgggcagagtaagagagtcgacttctgtggaaaaggctaccacctgatgtcctttccccaaagcgcgccacatggtgtggttttcctacacgtgacttatgtcccggcccaggagaagaattttaccacagctcctgcaatctgccacgatggcaaagcccatttccccagggaaggggtatttgtgtctaacggaactcactggttcgttacccagcgcaatttttacgagccacagataattacaacggacaacaccttcgtgagcggcaattgtgatgtcgtgatcgggatcgtaaacaatactgtgtatgaccccctgcaacctgagctcgattccttcaaggaggaactggacaaatactttaagaaccatacatcaccagatgtcgaccttggagatattagtggcatcaatgccagcgttgtgaacattcagaaggaaatagaccgattgaatgaggtggctaaaaacctgaacgaatctttaatcgacctccaggagctgggtaagtatgagcagtacattaaatggccctggtatatctggcttgggttcattgcaggactgatcgccatagtcatggtgaccatcatgctatgctgtatgacttcctgctgttcatgcctcaagggctgttgcagttgtggtagctgctgcaaatttgatgaagacgattccgagcctgttctgaagggcgtaaagttgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12963 - RNA, 4039 nt, synthetic construct
  misc_feature 1..4039: note = SARS-CoV-2/England/200990660/2020__EPI_ISL_414523 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctaagctccacagcctcagcactgggcaaactccaggacgtcgttaatcagaacgcgcaggccctgaatactcttgtgaagcaattgagcagtaactttggtgctatctcttccgtactgaatgacatattaagccgactcgataaggtggaagccgaggtccagatcgacagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggatttctgtggcaaaggttaccacctaatgtcctttccccaaagcgcgccacatggcgtcgtgttcctgcacgttacttatgtgccggcccaggagaagaattttaccacagctcctgcaatctgccacgacgggaaagcccatttccccagggaaggagtctttgtatctaacggcactcactggttcgtgacccagcgcaatttttacgagccacagataattacaacggataacaccttcgttagcgggaattgtgacgtggtcatcggaatcgtgaacaatactgtatatgatcccctccaacctgagctggactccttcaaggaagaacttgataaatactttaagaaccatacatcaccagacgtggatttgggcgacattagtggtatcaatgccagcgtcgttaacattcagaaggaaatagatcgactgaatgaggtggctaaaaacttaaacgaatctctcatcgacctgcaggagcttgggaagtatgagcagtacattaaatggccctggtatatctggctgggattcattgcaggcctaatcgccatagtgatggtcaccatcatgctctgctgtatgacttcctgctgttcatgcctgaagggttgttgcagttgtggcagctgctgcaaatttgacgaagatgactccgagttggtgctgaagggggttaagttacactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12964 - RNA, 4039 nt, synthetic construct
  misc_feature 1..4039: note = SARS-CoV-2/Australia/NSW09/2020__EPI_ISL_413595 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctacccccactgttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctcagctttacagcctccgcactgggaaaactccaggacgtcgttaatcagaacgcgcaggccctgaatactcttgtgaagcaattgtcaagcaacttcggcgctatcagttctgtactgaatgatatattatcccgactcgacaaggtggaagccgaggtccagatcgatagactgattaccggtaggcttcagagcctgcaaacgtacgtgacacagcagttgatccgcgcagctgagattcgggcctcggcaaacctcgccgctaccaaaatgtcagaatgcgttctggggcagtctaagagagtggacttttgtggaaaaggctaccacctaatgagtttcccccaatccgcgccacatggtgtcgtgtttctgcacgttacttatgtgccggcccaggagaagaatttcaccacagctcctgcaatctgccacgatggcaaagcccattttcccagggaaggggtcttcgtaagcaacggaactcactggtttgtgacccagcgcaatttctacgagccacagataattacaacggacaacaccttcgtttctggcaattgtgatgtggtcatcgggatcgtgaacaatactgtatatgaccccctccaacctgagctggatagctttaaggaggaacttgacaaatacttcaagaaccatacatccccagatgtggacttgggagatatttcaggcatcaatgccagtgtcgttaacattcagaaggaaatagaccgactgaatgaggtggctaaaaacttaaacgaaagcctcatcgacctgcaggagcttggtaagtatgagcagtacattaaatggccctggtatatctggctggggtttattgcaggactaatcgccatagtgatggtcaccatcatgctctgctgtatgacttcttgctgttcctgcctgaagggctgttgctcatgtggtagttgctgcaaattcgatgaagacgatagcgagcctgtgttgaagggcgttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12965 - RNA, 4039 nt, synthetic construct
  misc_feature 1..4039: note = SARS-CoV-2/Australia/NSW10/2020__EPI_ISL_413596 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcgttagcggcaattgtgatgtggtcatcgggatcgtgaacaatactgtatatgaccccctccaacctgagctggattccttcaaggaggaacttgacaaatactttaagaaccatacatcaccagatgtggacttgggagatattagtggcatcaatgccagcgtcgttaacattcagaaggaaatagaccgactgaatgaggtggctaaaaacttaaacgaatctctcatcgacctgcaggagcttggtaagtatgagcagtacattaaatggccctggtatatctggctggggttcattgcaggactaatcgccatagtgatggtcaccatcatgctctgctgtatgacttcctgctgttcatgcctgaagggctgttgcagttgtggtagctgctttaaattcgatgaagacgattccgagcctgtgttgaagggcgttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12966 - RNA, 4039 nt, synthetic construct
  misc_feature 1..4039: note SARS-CoV-2/Switzerland/1000477797/2020__EPI_ISL_413023 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaatatctacagtaaacacaccccaataaacttagttagggacctgccccagggatttagcgctcttgagcctttggtggatctgccaatcggcattaatatcacacggttccagactctactcgccctgcatcgctcttatcttaccccgggcgactcctcaagcgggtggacagcaggagccgctgcatactatgtaggttacctgcaacccagaacctttttgctcaagtataacgaaaatggcacgattactgatgccgtggactgcgctctggatcctttaagtgagacaaaatgtaccctgaagtctttcactgtcgaaaaggggatctaccagacatccaactttagggtgcagccaaccgagagcatagttcggttccccaatattacgaacctctgcccttttggagaggtgttcaatgccacccgcttcgcgtcggtctatgcatggaaccgaaaaagaatctctaattgtgtggccgactactccgtactttacaactcagctagttttagcacattcaagtgctatggcgtttccccaactaaactgaatgacttgtgttttaccaacgtgtacgccgattctttcgtcattaggggtgacgaagtgcggcagatcgcacccgggcaaacaggaaagatcgctgattataattacaaactaccggacgattttactggctgcgtcattgcctggaacagcaacaatctggactcaaaggtgggcgggaactataattacctctatcgtctgttccgcaaaagtaaccttaagccttttgagagagatatatccaccgaaatctaccaggcgggaagcacaccctgtaatggtgttgagggcttcaactgctactttccactgcagtcttatgggttccaacctaccaatggagtgggctaccagccctatagggtagtcgtgttgtcatttgaactcctgcacgccccagcaactgtttgcggtcccaagaaaagtacgaacttagtgaagaataaatgtgtcaacttcaattttaacgggctgacaggcaccggagtgctaactgagagcaataagaaattcctccctttccagcagtttggccgggacattgctgataccacagacgccgtacgagatccacaaaccctggagatccttgacataactccgtgctccttcgggggagtgtctgttattacacccggtacgaacacctcgaatcaggtcgctgtgttgtaccagggcgtgaactgtactgaagtccctgttgccatccacgcagaccagctgacaccaacctggcgcgtgtatagcacagggtccaacgtgtttcaaactagagccggatgcctcatcggcgctgagcatgtaaataactcatacgaatgtgatattcccatcggtgcggggatttgcgcaagttatcagacccagaccaattctcctaggcgggcccgcagcgtcgcttcccagtcaataatcgcctacacgatgagcctgggcgcagagaactctgtggcctactccaataacagtattgctatcccaacaaatttcactatcagcgttaccacagaaattcttcccgtgtctatgactaagacctccgtcgactgtacgatgtatatatgcggagattcaacagagtgtagtaacctgttgctccaatacggcagcttttgcacccagctgaatagagccttaactgggatcgcagtggagcaggacaagaacacacaggaagttttcgcgcaagtgaaacagatttataagaccccgcctatcaaagattttggaggtttcaatttttcgcagattctgccagacccctccaagccttctaaaaggagcttcatcgaggatctactctttaacaaggtaactctggctgacgccggcttcataaagcaatacggggattgtcttggagacatcgcagcccgtgatttgatttgcgctcagaaattcaatggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaacggcataggggtgacccagaatgtgctctatgagaaccagaagctgattgccaaccagttcaattccgctatcggaaaaattcaagattctctaagctccacagcctcagcactgggcaagctccaggacgtcgttaaccagaatgcgcaggccctgaacactcttgtgaaacaattgagcagtaattttggtgctatctcttccgtactgaacgacatattaagccgactcgataaggtggaagccgaggtccagatcgacagactgattaccgggaggcttcagtcgctgcaaacgtacgtgacacagcagttgatccgcgcagctgagattcgggcctcagcaaatctcgccgctaccaagatgtctgaatgcgttctgggacagagtaaaagagtggatttctgtggcaagggttaccacctaatgtcctttccccaaagcgcgccacatggcgtcgtgttcctgcacgttacttatgtgccggcccaggagaaaaactttaccacagctcctgcaatctgccacgacgggaaggcccatttccccagggaaggagtctttgtatctaatggcactcactggttcgtgacccagcgcaacttttacgagccacagataattacaacggataataccttcgttagcgggaactgtgacgtggtcatcggaatcgtgaataacactgtatatgatcccctccaacctgagctggactccttcaaagaagaacttgataagtactttaaaaatcatacatcaccagacgtggatttgggcgacattagtggtatcaacgccagcgtcgttaatattcagaaggaaatagatcgactgaacgaggtggctaagaacttaaatgaatctctcatcgacctgcaggagcttgggaaatatgagcagtacattaagtggccctggtatatctggctgggattcattgcaggcctaatcgccatagtgatggtcaccatcatgctctgctgtatgacttcctgctgttcatgcctgaaaggttgttgcagttgtggcagctgctgcaagtttgacgaagatgactccgagcctgtgttgaaaggggttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12967 - RNA, 4039 nt, synthetic construct
  misc_feature 1..4039: note = SARS-CoV-2/Belgium/BA-02291/2020__EPI_ISL_415159 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcagaagtaatcttaagccttttgagagggatatatccaccgaaatctaccaggcgggaagcacaccctgtaacggtgttgagggcttcaattgctactttccactgcagtcttatgggttccaacctaccaacggagtgggctaccagccctatcgggtagtcgtgttgtcatttgaactcctgccagcccccgcaactgtttgcggtcctaagaaaagtacgaatttagtgaagaacaaatgtgtcaatttcaactttaatgggctgacaggcaccggagtgctaactgagagcaacaagaaattcctcccattccagcagtttggccgagacattgctgataccacagacgccgtacgcgatccgcaaaccctggagatccttgacataactccctgctccttcgggggagtgtctgttattacacctggtacgaatacctcgaaccaggtcgctgtgttgtaccagggcgtgaattgtactgaagtcccagttgccatccacgcagaccagctgacacccacctggagagtgtatagcacagggtccaacgtgtttcaaactagggccggatgcctcatcggcgctgagcacgtaaacaattcatacgaatgtgatattcctatcggtgcggggatttgcgcaagttatcagacccagacgaactctccacggcgcgccagaagcgtcgcttcccagtcaataatcgcctacaccatgagcctgggcgcagaaaattctgtggcctactccaacaatagtattgctatccccacaaacttcactatcagcgttaccacagaaattcttccggtgtctatgactaagacctccgtcgactgtacgatgtatatatgcggagattcaacagagtgtagtaatctgttgctccaatacggcagcttttgcacccagctgaacagggccttaactgggatcgcagtggagcaggacaagaatacacaggaagttttcgcgcaagtgaaacagatttataagacccctccaatcaaagattttggaggtttcaacttttcgcagattctgcccgacccttccaagccctctaaacgtagcttcatcgaggatctactctttaataaggtaactctggctgacgccggcttcataaagcaatacggggattgtcttggagacatcgcagcccgggatttgatttgcgctcagaaattcaacggcctgaccgtcctcccacctctgttaacagacgaaatgatcgcccagtatacgtcagcactgcttgctggtaccattacgagtgggtggacatttggcgccggagcggccttgcagatccccttcgctatgcaaatggcataccgatttaatggcataggggtgacccagaacgtgctctatgagaatcagaagctgattgccaaccagttcaactccgctatcggaaaaattcaagattctctaagctccgccgcaccagcgctgggcaagctccaggacgtcgttaatcagaacgcccaggctctgaatacacttgtgaaacaattgtcaagcaactttggtgccatcagttctgtactgaatgacatattatccagactcgataaggtggaagcagaggtccagatcgacaggctgattactgggcgccttcagagcctgcaaacctacgtgacgcagcagttgatccgggctgccgagattagagcatcggccaacctcgctgcgacaaagatgtcagaatgcgttctgggacagtctaaaagggtggatttctgtggcaagggttaccatctaatgagttttccgcaatccgcccctcacggcgtcgtgttcctgcatgttacctatgtgcccgcacaggagaaaaattttactaccgctccagccatctgccacgacgggaaggcccacttcccccgcgaaggagtctttgtaagcaacggcacacattggttcgtgactcagcgaaatttttacgagcctcagataattaccacagataacacgttcgtttctgggaattgtgacgtggtcatcggaatcgtgaacaataccgtatatgatccactccaacccgagctggacagcttcaaagaagaacttgataagtactttaaaaaccacacttcccctgacgtggatttgggcgacatttcaggtatcaatgctagtgtcgttaacattcagaaggaaatagatcggctgaatgaggtggcaaagaacttaaacgaaagcctcatcgacctgcaggagcttgggaaatatgagcagtacattaagtggccgtggtatatctggctgggattcattgccggcctaatcgcgatagtgatggtcacaatcatgctctgctgtatgacctcttgctgttcctgcctgaaaggttgttgctcatgtggcagttgctgcaagtttgacgaagatgacagcgagccagtgttgaaaggggttaagctgcattacacttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12968 - RNA, 4039 nt, synthetic construct
  misc_feature 1..4039: note = SARS-CoV-2/USA/WA8-UW5/2020__EPI_ISL_413486 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagtacgtaaacaattcatatgaatgtgacattcccatcggcgcgggtatttgcgcaagttaccagacccagacgaactctcctaggcgggcccgcagcgtcgcttcccagtcaataatcgcctacaccatgagcctgggggcagaaaattctgtggcctattccaacaatagtattgctatcccaacaaacttcactatcagcgttaccacagaaattcttcccgtgtctatgactaagacctccgtcgattgtacgatgtacatatgcggcgactcaacagagtgtagtaatctgttgctccaatatggcagcttttgcacccagctgaacagagccttaactggaatcgcagtggagcaggataaaaatacacaggaagttttcgcgcaagtgaagcagatttacaaaaccccgcctatcaaggactttgggggattcaacttttcgcagattctgccagatccctccaaaccttctaagaggagcttcatcgaggacctactctttaataaggtaactctggctgatgccggtttcataaaacaatatggcgactgtcttggggatatcgcagcccgtgacttgatttgcgctcagaagttcaacggactgaccgtcctgcccccactcttaacagatgaaatgatcgcccagtacacgtcagcactgcttgctggcaccattacgagtggttggacatttggggccggcgcggccttgcagatccctttcgctatgcaaatggcatatcggtttaatggaataggcgtgacccagaacgtgctctacgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctatcatctaatgtcctttccccaaagcgcgccacacggtgtcgtgttcctgcatgttacttacgtgccggcccaggagaagaattttaccacagctcctgcaatctgccacgatggcaaagcccacttccccagggaaggggtctttgtatctaacggaactcattggttcgtgacccagcgcaatttttatgagccacagataattacaacggacaacaccttcgttagcggcaattgtgatgtggtcatcgggatcgtgaacaatactgtatacgaccccctccaacctgagctggattccttcaaggaggaacttgacaaatattttaagaaccacacatcaccagatgtggacttgggagatattagtggcatcaatgccagcgtcgttaacattcagaaggaaatagaccgactgaatgaggtggctaaaaacttaaacgaatctctcatcgacctgcaggagcttggtaagtacgagcagtatattaaatggccctggtacatctggctggggttcattgcaggactaatcgccatagtgatggtcaccatcatgctctgctgtatgacttcctgctgttcatgcctgaagggctgttgcagttgtggtagctgctgcaaatttgatgaagacgattccgagcctgtgttgaagggcgttaagctgcattacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12969 - RNA, 4039 nt, synthetic construct
  misc_feature 1..4039: note = SARS-CoV-2/England/20102000506/2020__EPI_ISL_415147 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacgggtattgtcttggagatatcgcagcccgtgacttgatttgcgctcagaagttcaacggcctgaccgtcctgcccccactcttaacagatgaaatgatcgcccagtacacgtcagcactgcttgctggtaccattacgagtgggtggacatttggcgccggagcggccttgcagatccctttcgctatgcaaatggcatatcggtttaatggcataggggtgacccagaacgtgctctacgagaatcagaaactgattgccaaccagttcaactccgctatcggaaagattcaagactctctaagctccacagcctcagcactgggcaaactccaggatgtcgttaatcagaacgcgcaggccctgaatactcttgtgaagcaattgagcagtaactttggtgctatctcttccgtactgaatgacatattaagccgactcgacaaggtggaagccgaggtccagatcgatagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggacttctgtggcaaaggttatcacctaatgtcctttccccaaagcgcgccacatggcgtcgtgttcctgcacgttacttacgtgccggcccaggagaagaattttaccacagctcctgcaatctgccacgatgggaaagcccatttccccagggaaggagtctttgtatctaacggcactcactggttcgtgacccagcgcaatttttatgagccacagataattacaacggacaacaccttcgttagcgggaattgtgatgtggtcatcggaatcgtgaacaatactgtatacgaccccctccaacctgagctggattccttcaaggaagaacttgacaaatattttaagaaccatacatcaccagatgtggacttgggcgatattagtggtatcaatgccagcgtcgttaacattcagaaggaaatagaccgactgaatgaggtggctaaaaacttaaacgaatctctcatcgatctgcaggagcttgggaagtacgagcagtatattaaatggccctggtacatctggctgggattcattgcaggcctaatcgccatagtgatggtcaccatcatgctctgctgtatgacttcctgctgttcatgcctgaagggttgttgcagttgtggcagctgctgcaaatttgacgaagacgattccgagcctgtgttgaagggggttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12970 - RNA, 4039 nt, synthetic construct
  misc_feature 1..4039: note = SARS-CoV-2/Belgium/VAG-03013/2020__EPI_ISL_415155 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctaagctccacagccactgcactgggcaaactccaggacgtcgttaatcagaacgcgcaggccctgaatacccttgtgaagcaattgtcaagcaactttggtgctatcagttctgtactgaatgacatattatcccgactcgataaggtggaagccgaggtccagatcgacagactgattacggggaggcttcagagcctgcaaacatacgtgacccagcagttgatccgcgcagctgagattcgggcctcggcaaacctcgccgctactaaaatgtcagaatgcgttctgggacagtctaagagagtggatttctgtggcaaaggttaccacctaatgagttttccccaatccgcgccacatggcgtcgtgttcctgcacgttacctatgtgccggcccaggagaagaattttacaactgctcctgcaatctgccacgacgggaaagcccatttccccagggaaggagtctttgtaagcaacggcacccactggttcgtgacacagcgcaatttttacgagccacagataattacgaccgataacactttcgtttctgggaattgtgacgtggtcatcggaatcgtgaacaatacagtatatgatcccctccaacctgagctggacagcttcaaggaagaacttgataaatactttaagaaccatacctccccagacgtggatttgggcgacatttcaggtatcaatgccagtgtcgttaacattcagaaggaaatagatcgactgaatgaggtggctaaaaacttaaacgaaagcctcatcgacctgcaggagcttgggaagtatgagcagtacattaaatggccctggtatatctggctgggattcattgcaggcctaatcgccatagtgatggtcactatcatgctctgctgtatgacatcttgctgttcctgcctgaagggttgttgctcatgtggcagttgctgcaaatttgacgaagatgacagcgagcctgtgttgaagggggttaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12971 - RNA, 4039 nt, synthetic construct
  misc_feature 1..4039: note = SARS-CoV-2/Belgium/BC-03016/2020__EPI_ISL_415157 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctaagctccacagcccccgcactgggcaaactccaggacgtcgttaatcagaacgcgcaggccctgaatactcttgtgaagcaattgtcaagcaactttggtgctatcagttctgtactgaatgacatattatcccgactcgataaggtggaagccgaggtccagatcgacagactgattaccgggaggcttcagagcctgcaaacgtacgtgacacagcagttgatccgcgcagctgagattcgggcctcggcaaacctcgccgctaccaaaatgtcagaatgcgttctgggacagtctaagagagtggatttctgtggcaaaggttaccacctaatgagttttccacaatccgcgccgcatggcgtcgtgttcctgcacgttacttatgtgcctgcccaggagaagaattttaccacagcacccgctatctgccacgacgggaaagcccatttcccaagggaaggagtctttgtaagcaacggcactcactggttcgtgacccagcgcaatttttacgagccccagataattacaacggataacaccttcgtttctgggaattgtgacgtggtcatcggaatcgtgaacaatactgtatatgatcctctccaaccagagctggacagcttcaaggaagaacttgataaatactttaagaaccatacatcccccgacgtggatttgggcgacatttcaggtatcaatgccagtgtcgttaacattcagaaggaaatagatcgactgaatgaggtggctaaaaacttaaacgaaagcctcatcgacctgcaggagcttgggaagtatgagcagtacattaaatggccttggtatatctggctgggattcattgcaggcctaatcgccatagtgatggtcaccatcatgctctgctgtatgacttcttgctgttcctgcctgaagggttgttgctcatgtggcagttgctgcaaatttgacgaagatgacagcgagccggtgttgaagggggttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12972 - RNA, 4039 nt, synthetic construct
  misc_feature 1..4039: note = SARS-CoV-2/Germany/BavPat3/2020__EPI_ISL_414521 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacagcaagttttcgcacaggtgaagcagatttataaaaccccgcctatcaaggactttgggggattcaacttttcgcaaattctgccagatccctccaaaccttctaagaggagcttcatcgaagacctactctttaataaggtaactctggctgatgccggtttcataaaacagtacggcgactgtcttggggatatcgcagcccgtgacttgatttgcgctcagaagttcaacggactgaccgtcctgcccccactcttaacagatgagatgatcgcccagtatacgtcagcactgcttgctggcaccattacgagtggttggacatttggggccggcgcggccttgcaaatccctttcgctatgcagatggcataccggtttaatggaataggcgtgacccagaacgtgctctatgaaaatcagaaactgattgccaaccaattcaactccgctatcgggaagattcaggactctctaagctccacagcctcagcactgggaaaactccaggacgtcgttaatcagaacgcgcaagccctgaatactcttgtgaagcagttgagcagtaactttggcgctatctcttccgtactgaatgatatattaagccgactcgacaaggtggaggccgaagtccagatcgatagactgattaccggtaggcttcaatcgctgcagacgtacgtgacacagcagttgatccgcgcagctgagattcgggcctcagcaaacctcgccgctaccaaaatgtctgagtgcgttctggggcaaagtaagagagtggacttctgtggaaaaggctaccacctaatgtcctttccccagagcgcgccacatggtgtcgtgttcctgcacgttacttatgtgccggcccaggaaaagaattttaccacagcgcctgctatctgccacgatggcaaagcccatttccccagggagggggtctttgtatctaacggaactcactggttcgtgacccagcgcaatttttacgaaccacaaataattacaacggacaacaccttcgttagcggcaattgtgatgtggtcatcgggatcgtgaacaatactgtatatgaccccctccagcctgagctggattccttcaaggaggaacttgacaaatactttaagaaccatacatcaccagatgtggacttgggagatattagtggcatcaatgccagcgtcgttaacattcagaaggagatagaccgactgaatgaagtggctaaaaacttaaacgagtctctcatcgacctgcaggaacttggtaagtatgagcaatacattaaatggccctggtatatctggctggggttcattgcaggactaatcgccatagtgatggtcaccatcatgctctgctgtatgacttcctgctgttcatgcctgaagggctgttgcagttgtggtagctgctgcaaatttgatgaggacgattccgaacctgtgttgaagggcgttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12973 - RNA, 4039 nt, synthetic construct
  misc_feature 1..4039: note = SARS-CoV-2/France/HF1805/2020__EPI_ISL_414628 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctaagctccacagcctcagcactgggcaaactccaggacgtcgttaatcagaacgcgcaggccctgaatactcttgtgaagcaattgagcagtaactttggtgctatctcttccgtactgaatgacatattaagccgactcgataaggtggaagccgaggtccagatcgacagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggatttctgtggcaaaggttaccacctaatgtcctttccccaaagcgcgccacatggcgtcgtgttcctgcacgttacttatgtgccggcccaggagaagaattttaccacagctcctgcaatctgccacgacgggaaagcccatttccccagggaaggagtctttgtatctaacggcactcactggttcgtgacccagcgcaatttttacgagccacagataattacaacggataacaccttcgttagcgggaattgtgacgtggtcatcggagtggtaaacaatactgtgtatgatcccctccaacctgagctggactccttcaaggaagaacttgataaatactttaagaaccatacatcaccagacgtcgatttgggcgacatcagtggtattaatgccagcgttgtgaacatccagaaggaaattgatcgactgaatgaggtggctaaaaacttaaacgaatctctcatagacctgcaggagcttgggaagtatgagcagtacatcaaatggccctggtatatttggctgggattcatcgcaggcctaattgccatcgtcatggtgaccataatgctctgctgtatgacttcctgctgttcatgcctgaagggttgttgcagttgtggcagctgctgcaaatttgacgaagatgactccgagcctgttttgaagggggtaaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12974 - RNA, 4039 nt, synthetic construct
  misc_feature 1..4039: note SARS-CoV-2/Netherlands/ZuidHolland_9/2020__EPI_ISL_414445 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgtccagaagttcaacggcctgaccgtgctgcccccactcttaacagacgaaatgatcgctcagtatacgtcagccctgcttgcaggtaccattacgagtgggtggacatttggcgctggagccgcgttgcagatccctttcgccatgcaaatggcttaccggtttaatggcataggggtgacccagaacgtcctctatgagaatcagaaactgattgcaaaccagttcaactccgccatcggaaagattcaagattctctaagctccacagcttcagccctgggcaaactccaggacgttgtgaatcagaacgcacaggcgctgaatactcttgtaaagcaattgagcagtaactttggtgccatctcttccgtgctgaatgacatattaagccgactcgataaggtcgaagctgaggtgcagatcgacagactgattaccgggaggcttcagtcgctgcaaacgtacgttacacagcagttgatccgcgccgcagagattcgggcttcagccaacctcgcagccaccaaaatgtctgaatgcgtgctgggacagagtaagagagtcgatttctgtggcaaaggttaccacctaatgtcctttccccaaagcgctccacatggcgtggttttcctgcacgtgacttatgtcccggcgcaggagaagaattttaccacagcccctgcaatctgccacgacgggaaagctcatttccccagggaaggagtatttgtgtctaacggcactcactggttcgttacccagcgcaatttttacgagccacagataattacaacggataacaccttcgtgagcgggaattgtgacgtcgtgatcggaatcgtaaacaatactgtgtatgatcccctccaacctgagctggactccttcaaggaagaacttgataaatactttaagaaccatacatcaccagacgtcgatttgggcgacattagtggtatcaatgccagcgttgtgaacattcagaaggaaatagatcgactgaatgaggtggccaaaaacttaaacgaatctctcatcgacctgcaggagcttgggaagtatgagcagtacattaaatggccctggtatatctggctgggattcattgctggcctaatcgcaatagtcatggtgaccatcatgctctgctgtatgacttcctgctgttcatgcctgaagggttgttgcagttgtggcagctgctgcaaatttgacgaagatgactccgagcctgttttgaagggggtaaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12975 - RNA, 4039 nt, synthetic construct
  misc_feature 1..4039: note = SARS-CoV-2/Finland/FIN03032020A/2020__EPI_ISL_413602 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacaccaattctttcacgaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattagctggaactcaaataacctggacagtaaagtgggcgggaattataactacctctatcgtctgttccgcaagtccaatcttaagccttttgagagagatataagcaccgaaatctaccaggccggatctacaccctgtaacggtgttgagggcttcaattgctactttccactgcagtcatatgggttccaacctaccaacggagtgggctaccagccctatagggtagtcgtgttgagttttgaactcctgcacgcgccagccactgtttgcggtcccaaaaagagcacgaatttagtgaaaaacaagtgtgtcaatttcaactttaatgggctgacaggcaccggagtgctaactgagtccaacaaaaagttcctccctttccagcagtttggccgggacattgcagataccacagacgctgtacgagatccacaaaccctggagatccttgacataactccgtgctctttcgggggagtgtcggttattacacccggtacgaataccagcaaccaggtcgccgtgttgtaccagggcgtgaattgtactgaagtccctgttgctatccacgccgaccagctgacaccaacctggcgcgtgtattccacagggtcaaacgtgtttcaaactagagcaggatgcctcatcggcgccgagcatgtaaacaatagttacgaatgtgatattcccatcggtgctgggatttgcgcgtcttatcagacccagacgaacagccctaggcgggcacgctccgtcgcctcacagagcataatcgcttacaccatgtctctgggcgccgaaaattccgtggcatacagtaacaatagcattgccatcccaacaaacttcactatctctgttaccacagaaattcttcccgtgtccatgactaagacctcagtcgactgtacgatgtatatatgcggagatagtacagagtgtagcaatctgttgctccaatacggctcgttttgcacccagctgaacagagctttaactgggatcgccgtggagcaggacaaaaatacacaggaagttttcgcacaagtgaagcagatttataaaaccccgcctatcaaggattttggaggtttcaacttttcccagattctgccagacccctctaaacctagcaagaggtcattcatcgaggatctactctttaataaggtaactctggcggacgctggcttcataaaacaatacggggattgtcttggagacatcgccgcacgtgatttgatttgcgcccagaagttcaacggcctgaccgtcctgcccccactcttaacagacgaaatgatcgctcagtatacgagtgccctgcttgcaggtaccattacttccgggtggacatttggcgctggagccgcgttgcagatccctttcgccatgcaaatggcttaccggtttaatggcataggggtgacccagaacgtgctctatgagaatcagaaactgattgcaaaccagttcaactctgccatcggaaagattcaagatagcctatcctcaacagctagcgccctgggcaaactccaggacgtcgttaatcagaacgcacaggcgctgaatactcttgtgaagcaattgagttctaactttggtgccatctccagcgtactgaatgacatattatcgcgactcgataaggtggaagctgaggtccagatcgacagactgattaccgggaggcttcagtcactgcaaacgtacgtgacacagcagttgatccgcgccgcagagattcgggcttctgccaacctcgcagccaccaaaatgagtgaatgcgttctgggacagtccaagagagtggatttctgtggcaaaggttaccacctaatgagctttccccaatctgctccacatggcgtcgtgttcctgcacgttacttatgtgccggcgcaggagaagaattttaccacagcccctgcaatctgccacgacgggaaagctcatttccccagggaaggagtctttgtaagcaacggcactcactggttcgtgacccagcgcaatttttacgagccacagataattacaacggataacaccttcgtttccgggaattgtgacgtggtcatcggaatcgtgaacaatactgtatatgatcccctccaacctgagctggactcattcaaggaagaacttgataaatactttaagaaccatacaagtccagacgtggatttgggcgacattagcggtatcaatgcctctgtcgttaacattcagaaggaaatagatcgactgaatgaggtggccaaaaacttaaacgaatccctcatcgacctgcaggagcttgggaagtatgagcagtacattaaatggccctggtatatctggctgggattcattgctggcctaatcgcaatagtgatggtcaccatcatgctctgctgtatgacttcatgctgtagttgcctgaagggttgttgcagctgtggctcctgctgcaaatttgacgaagatgactctgagcctgtgttgaagggggttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12976 - RNA, 4039 nt, synthetic construct
  misc_feature 1..4039: note = SARS-CoV-2/France/GE1977/2020__EPI_ISL_414632 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctatttagcacagcctccgcactgggcaaactccaggacgtcgttaatcagaacgcgcaggccctgaatactcttgtgaagcaattgtcaagcaacttcggtgctatcagttctgtactgaatgacatattatcccgactcgataaggtggaagccgaggtccagatcgacagactgattaccgggaggcttcagagcctgcaaacgtacgtgacacagcagttgatccgcgcagctgagattcgggcctcggcaaacctcgccgctaccaaaatgtcagaatgcgttctgggacagtctaagagagtggatttttgtggcaaaggttaccacctaatgagtttcccccaatccgcgccacatggcgtcgtgtttctgcacgttacttatgtgccggcccaggagaagaatttcaccacagctcctgcaatctgccacgacgggaaagcccattttcccagggaaggagtcttcgtaagcaacggcactcactggtttgtgacccagcgcaatttctacgagccacagataattacaacggataacaccttcgtttctgggaattgtgacgtggtcatcggaatcgtgaacaatactgtatatgatcccctccaacctgagctggacagctttaaggaagaacttgataaatacttcaagaaccatacatccccagacgtggatttgggcgacatttcaggtatcaatgccagtgtcgttaacattcagaaggaaatagatcgactgaatgaggtggctaaaaacttaaacgaaagcctcatcgacctgcaggagcttgggaagtatgagcagtacattaaatggccctggtatatctggctgggatttattgcaggcctaatcgccatagtgatggtcaccatcatgctctgctgtatgacttcttgctgttcctgcctgaagggttgttgctcatgtggcagttgctgcaaattcgacgaagatgacagcgagcctgtgttgaagggggttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12977 - RNA, 4039 nt, synthetic construct
  misc_feature 1..4039: note = SARS-CoV-2/Finland/FIN-313/2020__EPI_ISL_414641 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttcaaaactctactcgccctgcatcgctcttatcttaccccgggcgactcctcaagcgggtggacagcaggagccgctgcatactatgtaggttacctgcagcccagaacctttttgctcaagtataatgaaaacggcacgattactgatgccgtggactgcgctctggatcctttaagtgagacaaagtgtaccctgaaatctttcactgtcgaaaaggggatctaccaaacatccaattttagggtgcagccaaccgagagcatagttcggttccccaacattacgaatctctgcccttttggagaggtgttcaacgccacccgcttcgcgtcggtctatgcatggaatcgaaaaagaatctctaactgtgtggccgactactccgtactttacaattcagctagttttagcacattcaagtgctatggcgtttccccaactaaactgaacgacttgtgttttaccaatgtgtacgccgattctttcgtcattaggggtgacgaagtgcggcagatcgcacccgggcagacaggaaagatcgctgattataactacaaactaccggacgattttactggctgcgtcattgcctggaatagcaacaacctggactcaaaggtgggcgggaattataactacctctatcgtctgttccgcaagagtaatcttaaaccttttgagagagatatatccaccgaaatctaccaagcgggaagcacaccctgtaacggtgttgagggcttcaattgctactttccactgcagtcttatgggttccagcctaccaacggagtgggctaccaaccctatagggtagtcgtgttgtcatttgaactcctgcacgccccagcaactgtttgcggtcccaagaaaagtacgaatttagtgaagaacaaatgtgtcaatttcaactttaatgggctgacaggcaccggagtgctaactgagagcaacaagaagttcctccctttccagcagtttggccgggacattgctgataccacagacgccgtacgagatccacagaccctggagatccttgacataactccgtgctccttcgggggagtgtctgttattacacccggtacgaatacctcgaaccaagtcgctgtgttgtaccagggcgtgaattgtactgaagtccctgttgccatccacgcagaccagctgacaccaacctggcgcgtgtatagcacagggtccaacgtgtttcagactagagccggatgcctcatcggcgctgagcatgtaaacaattcatacgaatgtgatattcccatcggtgcggggatttgcgcaagttatcaaacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaaaacctccgtcgactgtacgatgtatatatgcggagattcaacagagtgtagtaatctgttgctccagtacggcagcttttgcacccaactgaacagagccttaactgggatcgcagtggagcaggacaagaatacacaggaagttttcgcacaggtgaaacaaatttataagaccccgcctatcaaagattttggaggtttcaacttttcgcagattctgccagacccctccaagccttctaagaggagcttcatcgaggatctactctttaataaagtaactctggctgacgccggcttcataaagcagtacggggattgtcttggagacatcgcagcccgtgatttgatttgcgctcaaaaattcaacggcctgaccgtcctgcccccactcttaacagacgaaatgatcgcccagtatacgtcagcactgcttgctggtaccattacgagtgggtggacatttggcgccggagcggccttgcagatccctttcgctatgcagatggcataccggtttaatggcataggggtgacccaaaacgtgctctatgagaatcagaagctgattgccaaccagttcaactccgctatcggaaaaattcaggattctctaagctccacagcctcagcactgggcaagctccaagacgtcgttaatcagaacgcgcaggccctgaatactcttgtgaagcagttgagcagtaactttggtgctatctcttccgtactgaatgacatattaagccgactcgataaagtggaagccgaggtccaaatcgacagactgattaccgggaggcttcagtcgctgcagacgtacgtgacacaacagttgatccgcgcagctgagattcgggcctcagcaaacctcgccgctaccaagatgtctgaatgcgttctgggacagagtaaaagagtggatttctgtggcaagggttaccacctaatgtcctttccccagagcgcgccacatggcgtcgtgttcctgcacgttacttatgtgccggcccaagagaaaaattttaccacagcgcctgctatctgccacgacgggaaggcccatttccccagggaaggagtctttgtatctaacggcactcactggttcgtgacccagcgcaatttttacgagccacagataattacaacggataacaccttcgttagcgggaattgtgacgtggtcatcggaatcgtgaacaatactgtatatgatcccctccagcctgagctggactccttcaaagaagaacttgataagtactttaagaaccatacatcaccagacgtggatttgggcgacattagtggtatcaatgccagcgtcgttaacattcaaaaagaaatagatcgactgaatgaggtggctaagaacttaaacgaatctctcatcgacctgcaggagcttgggaaatatgagcagtacattaagtggccctggtatatctggctgggattcattgcaggcctaatcgccatagtgatggtcaccatcatgctctgctgtatgacttcctgctgttcatgcctgaaaggttgttgcagttgtggcagctgctgcaagtttgacgaagatgactccgagcctgtgttgaagggggttaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12978 - RNA, 4039 nt, synthetic construct
  misc_feature 1..4039: note SARS-CoV-2/Netherlands/ZuidHolland_2/2020__EPI_ISL_414556 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcactggagcaggacaaaaatacacaggaagtgttcgcgcaagttaagcagatttataaaaccccgcctatcaaggattttggaggtttcaacttttcgcagattctaccagacccctccaaaccttctaagaggagcttcatcgaggatctcctgtttaataaggtgactcttgctgacgccggcttcataaaacaatacggggattgtttgggagacatcgcagcccgtgatctgatttgcgctcagaagttcaacggcctcaccgtactgcccccattactgacagacgaaatgatcgcccagtatacgtcagcacttttggctggtaccattacgagtgggtggacatttggcgccggagcggccctccagatccctttcgctatgcaaatggcataccggtttaatggcataggggtcacccagaacgtgctgtatgagaatcagaaactaattgccaaccagttcaactccgctatcggaaagattcaagattctctgagctccacagcctcagcactcggcaaactgcaggacgtggtcaatcagaacgcgcaggcccttaatactttggttaagcaactgagcagtaactttggtgctatctcttccgtgttaaatgacatactcagccgactggataaggtagaagccgaggtgcagatcgacagacttattaccgggaggctgcagtcgttgcaaacgtacgtcacacagcagctcatccgcgcagctgagattcgggcctcagcaaacctggccgctaccaaaatgtctgaatgcgtgctaggacagagtaagagagttgatttctgtggcaaaggttaccacctgatgtcctttccccaaagcgcgccacatggcgtggtcttcctccacgtgacttatgttccggcccaggagaagaattttaccacagctcctgcaatctgccacgacgggaaagcccatttccccagggaaggagtgtttgtctctaacggcactcactggttcgtaacccagcgcaatttttacgagccacagataattacaacggataacaccttcgtgagcgggaattgtgacgttgtgatcggaatcgtcaacaatactgtgtatgatcccctgcaacctgagcttgactccttcaaggaagagttggataaatactttaagaaccatacatcaccagacgtagatctgggcgacattagtggtatcaatgccagcgtggtcaacattcagaaggaaatagatcgattaaatgaggttgctaaaaacctcaacgaatctctgatcgaccttcaggagctggggaagtatgagcagtacattaaatggccctggtatatctggctaggattcattgcaggcctcatcgccatagtgatggtgaccatcatgctgtgctgtatgacttcctgctgttcatgcttgaagggttgttgcagttgtggcagctgctgcaaatttgacgaagatgactccgagcctgtcctgaagggggtgaagttacactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12979 - RNA, 4039 nt, synthetic construct
  misc_feature 1..4039: note = SARS-CoV-2/USA/WA-UW31/2020__EPI_ISL_414618 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgccgagggcttcaattgctactttccactgcagtcttatgggttccaacctaccaacggagttggctaccagccctatagggtggtagtcttgtcatttgaactcctgcacgcaccagctactgtgtgcggtcccaaaaagagtacgaatttagttaaaaacaagtgtgtgaatttcaactttaatgggctgacaggcaccggagtcctaactgagagcaacaaaaagttcctccctttccagcagtttggccgggacattgccgataccacagacgctgtgcgagatccacaaaccctggagatccttgacataactccgtgctccttcgggggagtatctgtgattacacccggtacgaatacctcgaaccaggttgccgtcttgtaccaggacgtgaattgtactgaagtgcctgtcgcaatccacgccgatcagctgacaccaacctggcgcgtttatagcacaggctccaacgtgtttcaaactagagctgggtgcctcatcggagcggagcatgtgaacaattcatacgaatgtgacattcccatcggcgcaggtatttgcgccagttatcagacccagacgaactctcctaggcgggctcgcagcgtagcctcccagtcaataatcgcatacaccatgagcctgggggccgaaaattctgtcgcttactccaacaatagtattgccatcccaacaaacttcactatcagcgtgaccacagaaattcttcccgtttctatgactaagacctccgtggattgtacgatgtatatatgcggcgactcaacagagtgtagtaatctgttgctccaatacggcagcttttgcacccagctgaacagagcattaactggaatcgcggtcgagcaggataaaaatacacaggaagtgttcgctcaagttaagcagatttataaaaccccgcctatcaaggactttgggggattcaacttttcgcagattctgccagatccctccaaaccttctaagaggagcttcatcgaggacctactctttaataaggtgactctggccgatgcaggtttcataaaacaatacggcgactgtcttggggatatcgccgctcgtgacttgatttgcgcccagaagttcaacggactgaccgtactgcccccactcttaacagatgaaatgatcgcacagtatacgtcagctctgcttgccggcaccattacgagtggttggacatttggggcgggcgccgctttgcagatccctttcgcaatgcaaatggcctaccggtttaatggaataggcgtcacccagaacgtgctctatgagaatcagaaactgattgctaaccagttcaactccgccatcgggaagattcaagactctctaagctccacagcatcagcgctgggaaaactccaggacgtggtcaatcagaacgcccaggctctgaatactcttgttaagcaattgagcagtaactttggcgccatctcttccgtgctgaatgatatattaagccgactcgacaaggtagaagcagaggtgcagatcgatagactgattaccggtaggcttcagtcgctgcaaacgtacgtcacacagcagttgatccgcgctgccgagattcgggcatcagccaacctcgctgcgaccaaaatgtctgaatgcgtgctggggcagagtaagagagttgacttctgtggaaaaggctaccacctaatgtcctttccccaaagcgccccacatggtgtggtcttcctgcacgtgacttatgttccggcacaggagaagaattttaccacagctcctgccatctgccacgatggcaaagcccatttccccagggaaggggtgtttgtctctaacggaactcactggttcgtaacccagcgcaatttttacgagccacagataattacaacggacaacaccttcgtgagcggcaattgtgatgttgtgatcgggatcgtcaacaatactgtgtatgaccccctccaacctgagctggattccttcaaggaggaacttgacaaatactttaagaaccatacatcaccagatgtagacttgggagatattagtggcatcaatgctagcgtggtcaacattcagaaggaaatagaccgactgaatgaggttgccaaaaacttaaacgaatctctcatcgacctgcaggagcttggtaagtatgagcagtacattaaatggccctggtatatctggctggggttcattgcaggactaatcgcgatagtgatggtgaccatcatgctctgctgtatgacttcctgctgttcatgcctgaagggctgttgcagttgtggtagctgctgcaaatttgatgaagacgattccgagcctgtcttgaagggcgtgaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12980 - RNA, 4039 nt, synthetic construct
  misc_feature 1..4039: note = SARS-CoV-2/South Korea/SNU01/2020__EPI_ISL_411929 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacaccaattctttcacgaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggattttgggctcttgagcctttggtggatctgccaatcggcattaacatcacacggttccagactctactcgccctgcatcgcagctatcttaccccgggcgactcttcctcagggtggacagcaggagccgctgcatactatgtaggttacctgcaacccagaacctttttgctcaaatataatgaaaacggcacgattactgatgccgtggactgcgctctggatcctttaagcgagacaaagtgtaccctgaagagtttcactgtcgaaaaagggatctaccagacatctaattttagggtgcagccaaccgagtccatagttcggttccccaacattacgaatctctgcccttttggagaggtgttcaacgccacccgcttcgcgagcgtctatgcatggaatcgaaagagaatctcgaactgtgtggccgactactctgtactttacaattccgcttcatttagtacattcaaatgctatggcgttagcccaactaagctgaacgacttgtgttttaccaatgtgtacgccgattccttcgtcattaggggtgacgaagtgcggcagatcgcacccgggcaaacaggaaaaatcgctgattataactacaagctaccggacgattttactggctgcgtcattgcctggaactctaataacctggacagcaaagtgggcgggaattataactacctctatcgtctgttccgcaagtcaaatcttaagccttttgagagagatataagtaccgaaatctaccaggcgggatccacaccctgtaacggtgttgagggcttcaattgctactttccactgcagagctatgggttccaacctaccaacggagtgggctaccagccctatagggtagtcgtgttgtcttttgaactcctgcacgccccagcaactgtttgcggtcccaaaaagtcaacgaatttagtgaaaaacaagtgtgtcaatttcaactttaatgggctgacaggcaccggagtgctaactgagagtaacaaaaagttcctccctttccagcagtttggccgggacattgctgataccacagacgccgtacgagatccacaaaccctggagatccttgacataactccgtgcagcttcgggggagtgtccgttattacacccggtacgaatacctctaaccaggtcgctgtgttgtaccaggacgtgaattgtactgaagtccctgttgccatccacgcagatcagctgacaccaacctggcgcgtgtattcgacaggcagcaacgtgtttcaaactagagccgggtgcctcatcggagctgagcatgtaaacaattcctacgaatgtgacattcccatcggcgcgggtatttgcgcatcatatcagacccagacgaacagtcctaggcgggcccgctctgtcgctagccagtccataatcgcctacaccatgtcactgggggcagagaatagcgtggcctactctaacaattccattgctatcccaacaaacttcactatcagtgttaccacagaaattcttcccgtgagcatgactaagacctctgtcgattgtacgatgtatatatgcggcgactccacagagtgttcaaatctgttgctccaatacggaagtttttgcacccagctgaacagagccttaactggcatcgcagtggagcaggataaaaatacacaggaagttttcgcgcaagtgaagcagatttataaaaccccgcctatcaaggactttgggggattcaactttagccagattctgccagatccctcgaaaccttccaagaggtctttcatcgaggacctactctttaataaggtaactctggctgatgccggtttcataaaacaatacggcgactgtcttggggatatcgcagcccgtgacttgatttgcgctcagaagttcaacggactgaccgtcctccctccactgttaacagatgaaatgatcgcccagtatacgagcgcactgcttgctggcaccattacttcaggttggacatttggggccggcgcggccttgcagatccctttcgctatgcaaatggcataccggtttaatggaataggcgtgacccagaacgtgctctatgagaatcagaaactgattgccaaccagttcaacagtgctatcgggaagattcaagactccctatctagcacagcctccgcactgggaaaactccaggacgtcgttaatcagaacgcgcaggccctgaatactcttgtgaagcaattgtcaagcaactttggcgctatcagttctgtactgaatgatatattatcccgactcgacaaggtggaagccgaggtccagatcgatagactgattaccggtaggcttcagagcctgcaaacgtacgtgacacagcagttgatccgcgcagctgagattcgggcctcggcaaacctcgccgctaccaaaatgtcagaatgcgttctggggcagtctaagagagtggacttctgtggaaaaggctaccacctaatgagttttccccaatccgcgccacatggtgtcgtgttcctgcacgttacttatgtgccggcccaggagaagaattttaccacagcacccgctatctgccacgatggcaaagcccatttccccagggaaggggtctttgtaagcaacggaactcactggttcgtgacccagcgcaatttttacgagccacagataattacaacggacaacaccttcgtttctggcaattgtgatgtggtcatcgggatcgtgaacaatactgtatatgaccccctccaacctgagctggatagcttcaaggaagaacttgacaaatactttaagaaccatacatccccagatgtggacttgggagatatttcaggcatcaatgccagtgtcgttaacattcagaaggaaatagaccgactgaatgaggtggctaaaaacttaaacgaaagcctcatcgacctgcaggagcttggtaagtatgagcagtacattaaatggccctggtatatctggctggggttcattgcaggactaatcgccatagtgatggtcaccatcatgctctgctgtatgacttcttgctgttcctgcctgaagggctgttgctcatgtggtagttgctgcaaatttgatgaagacgatagcgagcctgtgttgaagggcgttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12981 - RNA, 4039 nt, synthetic construct
  misc_feature 1..4039: note = SARS-CoV-2/China/WF0004/2020__EPI_ISL_413694 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacacgaatagcttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggactgagtctgagttccgtgtgtacagctccgcgaataactgtacctttgagtatgtgtcacaacctttcctgatggacctggaaggcaagcagggtaattttaaaaacctcagagagttcgtctttaagaacattgatgggtacttcaaaatctacagtaagcacacaccaataaatttagttagggacctgccccagggatttagcgctcttgagcctttggtggatctgccaatcggcattaacatcactcggttccagaccctactcgccctgcatcgctcttatcttacaccgggcgactcctcaagcgggtggaccgcaggagccgctgcatactatgtaggttacctgcaacccagaacgtttttgctcaaatataatgaaaacggcactattacagatgccgtggactgcgctctggatcctttaagtgagaccaagtgtactctgaagtctttcacagtcgaaaaagggatctaccagacctccaattttagggtgcagccaacggagagcatagttcggttccccaacattaccaatctctgcccttttggagaggtgttcaacgccacacgcttcgcgtcggtctatgcatggaatcgaaagagaatctctaactgtgtggccgactactccgtactttacaattcagctagttttagcactttcaaatgctatggcgtttccccaaccaagctgaacgacttgtgttttacaaatgtgtacgccgattctttcgtcattaggggtgacgaagtgcggcagatcgcacccgggcaaactggaaaaatcgctgattataactacaagctaccggacgattttaccggctgcgtcattgcctggaatagcaacaacctggactcaaaagtgggcgggaattataactacctctatcgtctgttccgcaagagtaatcttaagccttttgagagagatatatccacagaaatctaccaggcgggaagcaccccctgtaacggtgttgagggcttcaattgctactttccactgcagtcttatgggttccaacctactaacggagtgggctaccagccctatagggtagtcgtgttgtcatttgaactcctgcacgccccagcaacggtttgcggtcccaaaaagagtacaaatttagtgaaaaacaagtgtgtcaatttcaactttaatgggctgaccggcactggagtgctaaccgagagcaacaaaaagttcctccctttccagcagtttggccgggacattgctgatacaaccgacgccgtacgagatccacaaactctggagatccttgacataacaccgtgctccttcgggggagtgtctgttattacgcccggtaccaatacttcgaaccaggtcgctgtgttgtaccaggacgtgaattgtacagaagtccctgttgccatccacgcagatcagctgaccccaacatggcgcgtgtatagcactggctccaacgtgtttcaaaccagagccgggtgcctcatcggagctgagcatgtaaacaattcatacgaatgtgacattcccatcggcgcgggtatttgcgcaagttatcagacgcagaccaactctcctaggcgggcccgcagcgtcgcttcccagtcaataatcgcctacacaatgagcctgggggcagaaaattctgtggcctactccaacaatagtattgctatcccaactaacttcaccatcagcgttacaactgaaattcttcccgtgtctatgaccaagacgtccgtcgattgtacaatgtatatatgcggcgactcaaccgagtgtagtaatctgttgctccaatacggatctttttgcactcagctgaacagagccttaacaggcatcgcagtggagcaggataaaaatacccaggaagttttcgcgcaagtgaagcagatttataaaactccgcctatcaaggactttgggggattcaacttttcgcagattctgccagatccctccaaaccttctaagaggagcttcatcgaggacctactctttaataaggtaaccctggctgatgccggtttcataaaacaatacggcgactgtcttggggatatcgcagcccgtgacttgatttgcgctcagaagttcaacggactgacagtcctgcccccactcttaacggatgaaatgatcgcccagtatacctcagcactgcttgctggcactattacaagtggttggacctttggggccggcgcggccttgcagatccctttcgctatgcaaatggcataccggtttaatggaataggcgtgacacagaacgtgctctatgagaatcagaaactgattgccaaccagttcaactccgctatcgggaagattcaagactctctaagctccactgcctcagcactgggaaaactccaggacgtcgttaatcagaacgcgcaggccctgaatacccttgtgaagcaattgagcagtaactttggcgctatctcttccgtactgaatgatatattaagccgactcgacaaggtggaagccgaggtccagatcgatagactgattacgggtaggcttcagtcgctgcaaacatacgtgacccagcagttgatccgcgcagctgagattcgggcctcagcaaacctcgccgctactaaaatgtctgaatgcgttctggggcagagtaagagattcgacttttgtggaaaaggctaccacctaatgtccttcccccaaagcgcgccacatggtgtggtctttctgcacgtgacctatgttccggcccaggagaagaatttcacaactgctcctgcaatctgccacgatggcaaagcccattttcccagggaaggggtgttcgtctctaacggaacccactggtttgtaacacagcgcaatttctacgagccacagataattacgaccgacaacactttcgtgagcggcaattgtgatgttgtgatcgggatcgtcaacaatacagtgtatgaccccctccaacctgagctggattcctttaaggaagaacttgacaaatacttcaagaaccatacctcaccagatgtagacttgggagatattagtggcatcaatgccagcgtggtcaacattcagaaggaaatagaccgactgaatgaggttgctaaaaacttaaacgaatctctcatcgacctgcaggagcttggtaagtatgagcagtacattaaatggccctggtatatctggctggggtttattgcaggactaatcgccatagtgatggtgactatcatgctctgctgtatgacatcctgctgttcatgcctgaagggctgttgcagttgtggtagctgctgcaaattcgatgaagacgattccgagcctgtcttgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12982 - RNA, 4039 nt, synthetic construct
  misc_feature 1..4039: note = SARS-CoV-2/China/WF0028/2020__EPI_ISL_413791 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcgttagcggcaattgtgatgtggtcatcgggatcgtgaacaatactgtatatgaccccctccaacctgagctggaatccttcaaggaggaacttgataaatactttaagaaccatacatcaccagacgtggatttgggagacattagtggcatcaatgccagcgtcgttaacattcagaaggagatagatcgactgaatgaagtggctaaaaacttaaacgagtctctcatcgacctgcaggagcttggtaagtatgaacagtacattaaatggccctggtatatctggctggggttcattgcaggactaatcgccatagtgatggtcaccatcatgctctgctgtatgacttcctgctgttcatgcctgaagggctgttgcagttgtggtagctgctgcaaatttgacgaggatgactccgaacctgtgttgaagggcgttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12983 - RNA, 4039 nt, synthetic construct
  misc_feature 1..4039: note = SARS-CoV-2/2019-nCoV/USA-CruiseA-18/2020__MT159716.1 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgaactgcgtgtgtacagctccgcgaataactgtactttcgagtatgtgtcacaaccttttctgatggacctcgaaggcaagcagggtaatttcaaaaacttaagagagtttgtcttcaagaacattgatgggtactttaaaatctacagtaagcacaccccaataaatctggttagggaccttccccagggattcagcgctttggagcctctggtggatctaccaatcggcattaacatcacacggtttcagactctcctggcccttcatcgctcttatctgaccccgggcgactcctcaagcgggtggacagcaggagccgctgcatactatgtaggttacttgcaacccagaaccttcctcctgaaatataatgaaaacggcacgattactgatgccgtggactgcgctttagatcctctgagtgagacaaagtgtaccctcaagtcttttactgtcgaaaaagggatctaccagacatccaatttcagggtgcagccaaccgagagcatagttcggtttcccaacattacgaatctttgccctttcggagaggtgtttaacgccacccgcttcgcgtcggtctatgcatggaatcgaaagagaatctctaactgtgtggccgactactccgtactgtacaattcagctagtttcagcacatttaaatgctatggcgtttccccaactaagttgaacgacctatgtttcaccaatgtgtacgccgattcttttgtcattaggggtgacgaagtgcggcagatcgcacccgggcaaacaggaaaaatcgctgattataactacaagctgccggacgatttcactggctgcgtcattgcctggaatagcaacaacctcgactcaaaagtgggcgggaattataactacctgtatcgtctttttcgcaagagtaatctgaagcctttcgagagagatatatccaccgaaatctaccaggcgggaagcacaccctgtaacggtgttgagggctttaattgctacttcccattgcagtcttatgggtttcaacctaccaacggagtgggctaccagccctatagggtagtcgtgctctcattcgaactgttacacgccccagcaactgtttgcggtcccaaaaagagtacgaatctggtgaaaaacaagtgtgtcaattttaacttcaatgggctaacaggcaccggagtgctcactgagagcaacaaaaagtttctgcctttccagcagttcggccgggacattgctgataccacagacgccgtacgagatccacaaacccttgagatcttggacataactccgtgctcctttgggggagtgtctgttattacacccggtacgaatacctcgaaccaggtcgctgtgctgtaccaggacgtgaattgtactgaagtccctgttgccatccacgcagatcagctcacaccaacctggcgcgtgtatagcacaggctccaacgtgttccaaactagagccgggtgcctgatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagccttggggcagaaaattctgtggcctactccaacaatagtattgctatcccaacaaactttactatcagcgttaccacagaaattctgcccgtgtctatgactaagacctccgtcgattgtacgatgtatatatgcggcgactcaacagagtgtagtaatttgctcctgcaatacggcagcttctgcacccagttaaacagagccctgactggaatcgcagtggagcaggataaaaatacacaggaagtttttgcgcaagtgaagcagatttataaaaccccgcctatcaaggacttcgggggatttaacttctcgcagattctaccagatccctccaaaccttctaagaggagctttatcgaggacctcctgttcaataaggtaactcttgctgatgccggttttataaaacaatacggcgactgtttgggggatatcgcagcccgtgacctgatttgcgctcagaagttcaacggactcaccgtcctgcccccattactgacagatgaaatgatcgcccagtatacgtcagcacttttggctggcaccattacgagtggttggacattcggggccggcgcggccctccagatcccttttgctatgcaaatggcataccggttcaatggaataggcgtgacccagaacgtgctgtatgagaatcagaaactaattgccaaccagtttaactccgctatcgggaagattcaagactctctgagctccacagcctcagcactcggaaaactgcaggacgtcgttaatcagaacgcgcaggcccttaatactttggtgaagcaactgagcagtaacttcggcgctatctcttccgtattaaatgatatactcagccgactggacaaggtggaagccgaggtccagatcgatagacttattaccggtaggctgcagtcgttgcaaacgtacgtgacacagcagctcatccgcgcagctgagattcgggcctcagcaaacctggccgctaccaaaatgtctgaatgcgttctagggcagagtaagagagtggacttttgtggaaaaggctaccacctgatgtccttcccccaaagcgcgccacatggtgtcgtgtttctccacgttacttatgtgccggcccaggagaagaatttcaccacagctcctgcaatctgccacgatggcaaagcccattttcccagggaaggggtcttcgtatctaacggaactcactggtttgtgacccagcgcaatttctacgagccacagataattacaacggacaacacctttgttagcggcaattgtgatgtggtcatcgggatcgtgaacaatactgtatatgaccccctgcaacctgagcttgattccttcaaggaagagttggacaaatacttcaagaaccatacatcaccagatgtggacctgggagatattagtggcatcaatgccagcgtcgttaacattcagaaggaaatagaccgattaaatgaggtggctaaaaacctcaacgaatctctgatcgaccttcaggagctgggtaagtatgagcagtacattaaatggccctggtatatctggctagggtttattgcaggactcatcgccatagtgatggtcaccatcatgctgtgctgtatgacttcctgctgttcatgcttgaagggctgttgcagttgtggtagctgctgcaaattcgatgaagacgattccgagcctgtgctgaagggcgttaagttacactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12984 - RNA, 4039 nt, synthetic construct
  misc_feature 1..4039: note SARS-CoV-2/SARS-CoV-2/Yunnan-01/human/2020/CHN__MT049951.1 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagccaatacgaactctttcaccaggggcgtatactatccggacaaggtgtttcggtcaagtgtcctgcacagcacacaggatctattcctcccctttttctccaatgtgacttggtttcatgctatccacgtttctgggaccaacggaacaaaacgcttcgacaatcctgtgctgccatttaacgatggtgtctacttcgcatcgaccgagaagtcaaatattatacgaggctggatctttgggactacacttgacagcaaaacccagagtctgttgattgtgaacaatgccacgaacgtagttatcaaggtgtgtgagttccagttttgcaatgatcccttcctcggagtctattaccataaaaacaataagtcctggatggagtctgagttccgtgtgtatagctccgcgaacaattgtacttttgaatacgtgtcacaacctttcctgatggacctggaaggcaagcagggtaactttaaaaacctcagagagttcgtctttaagaatattgatgggtatttcaaaatctacagtaagcacaccccaataaacttagttagggacctgccccagggatttagcgctcttgagcctttggtggatctgccaatcggcattaatatcacacggttccagactctactcgccctgcatcgctcttaccttaccccgggcgactcctcaagcgggtggacagcaggagccgctgcatattacgtaggttatctgcaacccagaacctttttgctcaaatacaacgaaaatggcacgattactgatgccgtggactgcgctctggatcctttaagtgagacaaagtgtaccctgaagtctttcactgtcgaaaaagggatctatcagacatccaactttagggtgcagccaaccgagagcatagttcggttccccaatattacgaacctctgcccttttggagaggtgttcaatgccacccgcttcgcgtcggtctacgcatggaaccgaaagagaatctctaattgtgtggccgactattccgtactttacaactcagctagttttagcacattcaaatgctacggcgtttccccaactaagctgaatgacttgtgttttaccaacgtgtatgccgattctttcgtcattaggggtgacgaagtgcggcagatcgcacccgggcaaacaggaaaaatcgctgattacaattataagctaccggacgattttactggctgcgtcattgcctggaacagcaacaatctggactcaaaagtgggcgggaactacaattatctctaccgtctgttccgcaagagtaaccttaagccttttgagagagatatatccaccgaaatctatcaggcgggaagcacaccctgtaatggtgttgagggcttcaactgctactttccactgcagtcttacgggttccaacctaccaatggagtgggctatcagccctacagggtagtcgtgttgtcatttgaactcctgcacgccccagcaactgtttgcggtcccaaaaagagtacgaacttagtgaaaaataagtgtgtcaacttcaattttaacgggctgacaggcaccggagtgctaactgagagcaataaaaagttcctccctttccagcagtttggccgggacattgctgataccacagacgccgtacgagatccacaaaccctggagatccttgacataactccgtgctccttcgggggagtgtctgttattacacccggtacgaacacctcgaatcaggtcgctgtgttgtatcaggacgtgaactgtactgaagtccctgttgccatccacgcagatcagctgacaccaacctggcgcgtgtacagcacaggctccaacgtgtttcaaactagagccgggtgcctcatcggagctgagcatgtaaataactcatatgaatgtgacattcccatcggcgcgggtatttgcgcaagttaccagacccagactaattctcctaggcgggcccgcagcgtcgcttcccagtcaataatcgcctataccatgagcctgggggcagagaactctgtggcctactccaataacagtattgctatcccaacaaatttcactatcagcgttaccacagaaattcttcccgtgtctatgactaagacctccgtcgattgtacgatgtacatatgcggcgactcaacagagtgtagtaacctgttgctccaatatggcagcttttgcacccagctgaatagagccttaactggaatcgcagtggagcaggataaaaacacacaggaagttttcgcgcaagtgaagcagatttacaaaaccccgcctatcaaggactttgggggattcaatttttcgcagattctgccagatccctccaaaccttctaagaggagcttcatcgaggacctactctttaacaaggtaactctggctgatgccggtttcataaaacaatatggcgactgtcttggggatatcgcagcccgtgacttgatttgcgctcagaagttcaatggactgaccgtcctgcccccactcttaacagatgaaatgatcgcccagtacacgtcagcactgcttgctggcaccattacgagtggttggacatttggggccggcgcggccttgcagatccctttcgctatgcaaatggcatatcggtttaacggaataggcgtgacccagaatgtgctctacgagaaccagaaactgattgccaaccagttcaattccgctatcgggaagattcaagactctctaagctccacagcctcagcactgggaaaactccaggacgtcgttaaccagaatgcgcaggccctgaacactcttgtgaagcaattgagcagtaattttggcgctatctcttccgtactgaacgatatattaagccgactcgacaaggtggaagccgaggtccagatcgatagactgattaccggtaggcttcagtcgctgcaaacgtatgtgacacagcagttgatccgcgcagctgagattcgggcctcagcaaatctcgccgctaccaaaatgtctgaatgcgttctggggcagagtaagagagtggacttctgtggaaaaggctaccacctaatgtcctttccccaaagcgcgccacatggtgtcgtgttcctgcacgttacttacgtgccggcccaggagaagaactttaccacagctcctgcaatctgccacgatggcaaagcccatttccccagggaaggggtctttgtatctaatggaactcactggttcgtgacccagcgcaacttttatgagccacagataattacaacggacaataccttcgttagcggcaactgtgatgtggtcatcgggatcgtgaataacactgtatacgaccccctccaacctgagctggattccttcaaggaagaacttgacaaatattttaagaatcatacatcaccagatgtggacttgggagatattagtggcatcaacgccagcgtcgttaatattcagaaggaaatagaccgactgaacgaggtggctaaaaacttaaatgaatctctcatcgacctgcaggagcttggtaagtacgagcagtatattaaatggccctggtacatctggctggggttcattgcaggactaatcgccatagtgatggtcaccatcatgctctgctgtatgacttcctgctgttcatgcctgaagggctgttgcagttgtggtagctgctgcaaatttgatgaagacgattccgagcctgtgttgaagggcgttaagctgcactatacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12985 - RNA, 4039 nt, synthetic construct
  misc_feature 1..4039: note = SARS-CoV-2/USA/WA-UW292/2020__EPI_ISL_418077 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacaccaattctttcacgaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgagctctacaccctgtaacggagttgagggtttcaattgctactttccactgcagtcatatggcttccaacctaccaacggggtgggataccagccctatagggtagtcgtgttgagttttgaactcctgcacgccccagcaactgtttgcggccccaaaaagagcacgaatttagtgaaaaacaagtgtgtcaatttcaactttaatggtctgacagggaccggcgtgctaactgagtccaacaaaaagttcctccctttccagcagtttggacgggacattgctgataccacagacgccgtacgagatccacaaaccctggagatccttgacataactccgtgctctttcggcggggtgtcggttattacacccggaacgaataccagcaaccaggtcgctgtgttgtaccaggacgtgaattgtactgaagtccctgttgccatccacgcagatcagctgacaccaacctggcgcgtgtattccacaggttcaaacgtgtttcaaactagagccggctgcctcatcggggctgagcatgtaaacaatagttacgaatgtgacattcccatcggagcgggcatttgcgcatcttatcagacccagacgaacagccctaggcgggcccgctccgtcgcttcacagagcataatcgcctacaccatgtctctgggtgcagaaaattccgtggcctacagtaacaatagcattgctatcccaacaaacttcactatctctgttaccacagaaattcttcccgtgtccatgactaagacctcagtcgattgtacgatgtatatatgcggggacagtacagagtgtagcaatctgttgctccaatacggctcgttttgcacccagctgaacagagccttaactggaatcgcagtggagcaggataaaaatacacaggaagttttcgcgcaagtgaagcagatttataaaaccccgcctatcaaggactttggcgggttcaacttttcccagattctgccagatccctctaaacctagcaagaggtcattcatcgaggacctactctttaataaggtaactctggctgatgccggattcataaaacaatacggtgactgtcttggcgatatcgcagcccgtgacttgatttgcgctcagaagttcaacgggctgaccgtcctccctccactgttaacagatgaaatgatcgcccagtatacgagtgcactgcttgctggaaccattacttccggctggacatttggtgccggggcggccttgcagatccctttcgctatgcaaatggcataccggtttaatggcataggagtgacccagaacgtgctctatgagaatcagaaactgattgccaaccagttcaactctgctatcggcaagattcaagacagcctatcctcaacagccagcgcactggggaaactccaggacgtcgttaatcagaacgcgcaggccctgaatactcttgtgaagcaattgagttctaactttggagctatctccagcgtactgaatgatatattatcgcgactcgacaaggtggaagccgaggtccagatcgatagactgattaccggcaggcttcagtcactgcaaacgtacgtgacacagcagttgatccgcgcagctgagattcgggcctctgcaaacctcgccgctaccaaaatgagtgaatgcgttctgggtcagtccaagagagtggacttctgtgggaaaggataccacctaatgagctttccccaatctgcgccacatggcgtcgtgttcctgcacgttacttatgtgccggcccaggagaagaattttaccacagcacccgctatctgccacgatggtaaagcccatttccccagggaaggcgtctttgtaagcaacgggactcactggttcgtgacccagcgcaatttttacgagccacagataattacaacggacaacaccttcgtttccggaaattgtgatgtggtcatcggcatcgtgaacaatactgtatatgaccccctccaacctgagctggattcattcaaggaagaacttgacaaatactttaagaaccatacaagtccagatgtggacttgggggatattagcggaatcaatgcctctgtcgttaacattcagaaggaaatagaccgactgaatgaggtggctaaaaacttaaacgaatccctcatcgacctgcaggagcttggcaagtatgagcagtacattaaatggccctggtatatctggctgggtttcattgcagggctaatcgccatagtgatggtcaccatcatgctctgctgtatgacttcatgctgtagttgcctgaagggatgttgcagctgtggctcctgctgcaaatttgatgaagacgattctgagcctgtgttgaagggtgttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12986 - RNA, 4039 nt, synthetic construct
  misc_feature 1..4039: note = SARS-CoV-2/Iceland/192/2020__EPI_ISL_417819 spike protein mRNA human (1-1273)
  source 1..4039: mol_type = other RNA
aggagaaagcttaccatgttcgtgtttttcgtcctgctcccccttgttagctcccagtgcgtgaacctgaccacaagaactcaattgcctccagcctacactaattcttttaccaggggcgtatattacccggacaaggtgttccggtcaagtgtcttacacagcacacaggatctgtttctacccttcttttccaacgtgacttggttccatgctatccacgtttctgggaccaatggaacaaaacgctttgacaaccctgtgctcccattcaatgatggtgtctattttgcatcgaccgagaagtcaaacattatacgaggctggatcttcgggactacactggacagcaaaacccagagtcttctgattgtgaataacgccacgaatgtagttatcaaggtgtgtgaatttcagttctgcaacgatcccttcttgggagtctactatcataaaaataacaagtcctggatggagtctgaatttcgtgtgtacagctccgcgaataactgtactttcgagtatgtgtcacaaccttttctcatggacctggaaggcaagcagggtaatttcaaaaacctgagagagtttgtcttcaagaacattgatgggtactttaaaatctacagtaagcacaccccaataaatctcgttagggacttaccccagggattcagcgctctggagcctcttgtggatttgccaatcggcattaacatcacacggtttcagactctgctagccctccatcgctcttatctgaccccgggcgactcctcaagcgggtggacagcaggagccgctgcatactatgtaggttaccttcaacccagaaccttcctgttgaaatataatgaaaacggcacgattactgatgccgtggactgcgctctcgatcctctgagtgagacaaagtgtaccttaaagtcttttactgtcgaaaaagggatctaccagacatccaatttcagggtgcagccaaccgagagcatagttcggtttcccaacattacgaatctgtgccctttcggagaggtgttcaacgccacccgctttgcgtcggtctatgcatggaatcgaaagagaatctctaactgtgtggccgactactccgtactctacaattcagctagtttcagcacatttaaatgctatggcgtttccccaactaaacttaacgacctgtgtttcaccaatgtgtacgccgattcttttgtcattaggggtgacgaagtgcggcagatcgcacccgggcaaacaggaaagatcgctgattataactacaagttgccggacgatttcactggctgcgtcattgcctggaatagcaacaacctagactcaaaagtgggcgggaattataactacctgtatcgtctctttcgcaagagtaatctgaagcctttcgagagagatatatccaccgaaatctaccaggcgggaagcacaccctgtaacggtgttgagggctttaattgctacttcccacttcagtcttatgggtttcaacctaccaacggagtgggctaccagccctatagggtagtcgtgctgtcattcgaattgctccacgccccagcaactgtttgcggtcccaaaaagagtacgaatctggtgaaaaacaagtgtgtcaattttaacttcaatgggttaacaggcaccggagtgctgactgagagcaacaaaaagttcctaccttttcagcagttcggccgggacattgctgataccacagacgccgtacgagatccacaaaccctcgagatcctggacataactccgtgctcctttgggggagtgtctgttattacacccggtacgaatacctcgaaccaggtcgctgtgctttaccagggcgtgaattgtactgaagtccctgttgccatccacgcagaccagttgacaccaacctggcgcgtgtatagcacagggtccaacgtgttccaaactagagccggatgcctgatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctcggcgcagaaaattctgtggcctactccaacaatagtattgctatcccaacaaactttactatcagcgttaccacagaaattctgcccgtgtctatgactaagacctccgtcgactgtacgatgtatatatgcggagattcaacagagtgtagtaatcttctgttgcaatacggcagcttctgcacccagctcaacagagccctgactgggatcgcagtggagcaggacaaaaatacacaggaagtttttgcgcaagtgaagcagatttataaaaccccgcctatcaaggatttcggaggttttaacttctcgcagattttaccagacccctccaaaccttctaagaggagctttatcgaggatctgctattcaataaggtaactctcgctgacgccggcttcataaaacaatacggggattgtctgggagacatcgcagcccgtgatcttatttgcgctcagaagtttaacggcttgaccgtcctgcccccactcctgacagacgaaatgatcgcccagtatacgtcagcattactggctggtaccattacgagtgggtggacattcggcgccggagcggcccttcagatcccttttgctatgcaaatggcataccggttcaatggcataggggtgacccagaacgtgttgtatgagaatcagaaactcattgccaaccagtttaactccgctatcggaaagattcaagattctctgagctccacagcctcagcactaggcaaactgcaggacgtcgttaatcagaacgcgcaggccctcaatactctggtgaagcaacttagcagtaacttcggtgctatctcttccgtattgaatgacatactgagccgattagataaggtggaagccgaggtccagatcgacagactcattaccgggaggctgcagtcgcttcaaacgtacgtgacacagcagctgatccgcgcagctgagattcgggcctcagcaaacttggccgctaccaaaatgtctgaatgcgttctcggacagagtaagagagtggatttttgtggcaaaggttaccacctgatgtccttcccccaaagcgcgccacatggcgtcgtgtttctacacgttacttatgtgccggcccaggagaagaatttcaccacagctcctgcaatctgccacgacgggaaagcccattttcccagggaaggagtcttcgtatctaacggcactcactggtttgtgacccagcgcaatttctacgagccacagataattacaacggataacaccttcgttagcgggaattgtgacgtggtcatcggaatcgtgaacaatactgtatatgatcccctgcaacctgagctcgactcctttaaggaggagctggataaatacttcaagaaccatacatcaccagacgtggatcttggcgacattagtggtatcaatgccagcgtcgttaacattcagaaggaaatagatcgattgaatgaggtggctaaaaacctgaacgaatctttaatcgacctccaggagctggggaagtatgagcagtacattaaatggccctggtatatctggcttggatttattgcaggcctgatcgccatagtgatggtcaccatcatgctatgctgtatgacttcctgctgttcatgcctcaagggttgttgcagttgtggcagctgctgcaaattcgacgaagatgactccgagcctgtgctgaagggggttaagttgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12987 - RNA, 4039 nt, synthetic construct
  misc_feature 1..4039: note = SARS-CoV-2/Belgium/ULG-6939/2020__EPI_ISL_417020 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggtttactccaacaatagtattgccatcccaacaaacttcactatcagcgtgaccacagaaattcttcccgtctctatgactaagacctccgtggactgtacgatgtatatatgcggagattcaacagagtgtagtaatctgttgctccaatacggcagcttttgcacccagctgaacagagctttaactgggatcgccgttgagcaggacaaaaatacacaggaagtgttcgcacaagtaaagcagatttataaaaccccgcctatcaaggattttggaggtttcaacttttcgcagattctgccagacccctccaaaccttctaagaggagcttcatcgaggatctactctttaataaggtcactctggcggacgctggcttcataaaacaatacggggattgtcttggagacatcgccgcacgtgatttgatttgcgcccagaagttcaacggcctgaccgtgctgcccccactcttaacagacgaaatgatcgctcagtatacgtcagccctgcttgcaggtaccattacgagtgggtggacatttggcgctggagccgcgttgcagatccctttcgccatgcaaatggcttaccggtttaatggcataggggtgacccagaacgtcctctatgagaatcagaaactgattgcaaaccagttcaactccgccatcggaaagattcaagattctctaagctccacagcttcagccctgggcaaactccaggacgttgtgaatcagaacgcacaggcgctgaatactcttgtaaagcaattgagcagtaactttggtgccatctcttccgtgctgaatgacatattaagccgactcgataaggtcgaagctgaggtgcagatcgacagactgattaccgggaggcttcagtcgctgcaaacgtacgttacacagcagttgatccgcgccgcagagattcgggcttcagccaacctcgcagccaccaaaatgtctgaatgcgtgctgggacagagtaagagagtcgatttctgtggcaaaggttaccacctaatgtcctttccccaaagcgctccacatggcgtggttttcctgcacgtgacttatgtcccggcgcaggagaagaattttaccacagcccctgcaatctgccacgacgggaaagctcatttccccagggaaggagtatttgtgtctaacggcactcactggttcgttacccagcgcaatttttacgagccacagataattacaacggataacaccttcgtgagcgggaattgtgacgtcgtgatcggaatcgtaaacaatactgtgtatgatcccctccaacctgagctggactccttcaaggaagaacttgataaatactttaagaaccatacatcaccagacgtcgatttgggcgacattagtggtatcaatgccagcgttgtgaacattcagaaggaaatagatcgactgaatgaggtggccaaaaacttaaacgaatctctcatcgacctgcaggagcttgggaagtatgagcagtacattaaatggccctggtatatctggctgggattcattgctggcctaatcgcaatagtcatggtgaccatcatgctctgctgtatgacttcctgctgttcatgcctgaagggttgttgcagttgtggcagctgctgcaaatttgacgaagatgactccgagcctgttttgaagggggtaaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12988 - RNA, 4039 nt, synthetic construct
  misc_feature 1..4039: note = SARS-CoV-2/France/HF2496/2020__EPI_ISL_418231 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgtcgcacgtgatttgatttgcgcccagaagttcaacggcctgaccgtgctgcccccactcttaacagacgaaatgatcgctcagtatacgtcagccctgcttgcaggtaccattacgagtgggtggacatttggcgctggagccgcgttgcagatccctttcgccatgcaaatggcttaccggtttaatggcataggggtgacccagaacgtcctctatgagaatcagaaactgattgcaaaccagttcaactccgccatcggaaagattcaagattctctaagctccacagcttcagccctgggcaaactccaggacgttgtgaatcagaacgcacaggcgctgaatactcttgtaaagcaattgagcagtaactttggtgccatctcttccgtgctgaatgacatattaagccgactcgataaggtcgaagctgaggtgcagatcgacagactgattaccgggaggcttcagtcgctgcaaacgtacgttacacagcagttgatccgcgccgcagagattcgggcttcagccaacctcgcagccaccaaaatgtctgaatgcgtgctgggacagagtaagagagtcgatttctgtggcaaaggttaccacctaatgtcctttccccaaagcgctccacatggcgtggttttcctgcacgtgacttatgtcccggcgcaggagaagaattttaccacagcccctgcaatctgccacgacgggaaagctcatttccccagggaaggagtatttgtgtctaacggcactcactggttcgttacccagcgcaatttttacgagccacagataattacaacggataacaccttcgtgagcgggaattgtgacgtcgtgatcggaatcgtaaacaatactgtgtatgatcccctccaacctgagctggactccttcaaggaagaacttgataaatactttaagaaccatacatcaccagacgtcgatttgggcgacattagtggtatcaatgccagcgttgtgaacattcagaaggaaatagatcgactgaatgaggtggccaaaaacttaaacgaatctctcatcgacctgcaggagcttgggaagtatgagcagtacattaaatggccctggtatatctggctgggattcattgctggcctaatcgcaatagtcatggtgaccatcatgctctgctgtatgacttcctgctgttcatgcctgaagggttgttgcagttgtggcagctgctgcaaatttgacgaagatgactccgagcctgttttgaagggggtaaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12989 - RNA, 4039 nt, synthetic construct
  misc_feature 1..4039: note = SARS-CoV-2/USA/WA-UW291/2020__EPI_ISL_418076 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaatactctctaagctccacagcctcagcactgggcaaactccaggatgtcgttaatcagaacgcgcaggccctgaatactcttgtgaagcaattgagcagtaactttggtgctatctcttccgtactgaatgacatattaagccgactcgacaaggtggaagccgaggtccagatcgatagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggacttctgtggcaaaggttatcacctaatgtcctttccccaaagcgcgccacatggcgtcgtgttcctgcacgttacttacgtgccggcccaggagaagaattttaccacagctcctgcaatctgccacgatgggaaagcccatttccccagggaaggagtctttgtatctaacggcactcactggttcgtgacccagcgcaatttttatgagccacagataattacaacggacaacaccttcgttagcgggaattgtgatgtggtcatcggaatcgtgaacaatactgtatacgaccccctccaacctgagctggattccttcaaggaagaacttgacaaatattttaagaaccatacatcaccagatgtggacttgggcgatattagtggtatcaatgccagcgtcgttaacattcagaaggaaatagaccgactgaatgaggtggctaaaaacttaaacgaatctctcatcgatctgcaggagcttgggaagtacgagcagtatattaaatggccctggtacatctggctgggattcattgcaggcctaatcgccatagtgatggtcaccatcatgctctgctgtatgacttcctgctgttcatgcctgaagggttgttgcagttgtggcagctgctgcaaatttgacgaagacgattccgagcctgtgttgaagggggttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12990 - RNA, 4039 nt, synthetic construct
  misc_feature 1..4039: note = SARS-CoV-2/Portugal/PT0034/2020__EPI_ISL_418019 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctaagctccacagcctcagcactgggcaaactccaggacgtcgttaatcagaacgcgcaggccctgaatactcttgtgaagcaattgagcagtaactttggtgctatctcttccgtactgaatgacatattaagccgactcgataaggtggaagccgaggtccagatcgacagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggatttctgtggcaaaggttaccacctaatgtcctttccccaaagcgcgccacatggcgtcgtgttcctgcacgttacttatgtgccggcccaggagaagaattttaccacagctcctgcaatctgccacgacgggaaagcccatttccccagggaaggagtctttgtatctaacggcactcactggttcgtgacccagcgcaatttttacgagccacagataattacaacggataacaccttcgttagcgggaattgtgacgtggtcatcggaatcgtgaacaatactgtatatgatcccctccaacctgagctggactccttcaaggaagaacttgataaatactttaagaaccatacatcaccagacgtggatttgggcgacattagtggtatcaatgccagcgtcgttaacattcagaaggaaatagatcgactgaatgaggtggctaaaaacttaaacgaatctctcatcgacctgcaggagcttgggaagtatgagcagtacattaaatggccctggtatatctggctgggattcattgcaggcctaatcgccatagtgatggtcaccatcatgctctgctgtattacttcctgctgttcatgcctgaagggttgttgcagttgtggcagctgctgcaaatttgacgaagatgactccgagcctgtgttgaagggggttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12991 - RNA, 4039 nt, synthetic construct
  misc_feature 1..4039: note = SARS-CoV-2/Iceland/202/2020__EPI_ISL_417750 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcgttagcggcaattgtgatgtggtcatcgggatcgtgaacaatactgtatatgaccccctccaacctgagctggattccttcaaggaggaacttgacaaatactttaagaaccatacatcaccagatgtggacttgggagatattcccggcatcaatgccagtgtcgttaacattcagaaggaaatagaccgactgaatgaggtggctaaaaacttaaacgaaagcctcatcgacctgcaggagcttggtaagtatgagcagtacattaaatggccttggtatatctggctggggttcattgcaggactaatcgccatagtgatggtcaccatcatgctctgctgtatgacttcttgctgttcctgcctgaagggctgttgctcatgtggtagttgctgcaaatttgatgaagacgatagcgagccggtgttgaagggcgttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12992 - RNA, 4039 nt, synthetic construct
  misc_feature 1..4039: note = SARS-CoV-2/USA/WA-UW261/2020__EPI_ISL_418046 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacacgaatagcttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcacatcggtctatgcgtggaatcgaaagagaatctctaactgtgtggcagactactccgtactttacaattcagccagttttagcactttcaaatgctatggcgtttccccaaccaagctgaacgacttgtgttttacaaatgtgtacgctgattctttcgtcattaggggtgacgaagtgcggcagatcgcccccgggcaaactggaaaaatcgcagattataactacaagctaccggacgattttaccggctgcgtcattgcttggaatagcaacaacctggactcaaaagtgggcgggaattataactacctctatcgtctgttccgcaagagtaatcttaagccttttgagagagatatatccacagaaatctaccaggccggaagcaccccctgtaacggtgttgagggcttcaattgctactttccactgcagtcttatgggttccaacctactaacggagtgggctaccagccctatagggtagtcgtgttgtcatttgaactcctgcacgcgccagccacggtttgcggtcccaaaaagagtacaaatttagtgaaaaacaagtgtgtcaatttcaactttaatgggctgaccggcactggagtgctaaccgagagcaacaaaaagttcctccctttccagcagtttggccgggacattgcagatacaaccgacgctgtacgagatccacaaactctggagatccttgacataacaccgtgctccttcgggggagtgtctgttattacgcccggtaccaatacttcgaaccaggtcgccgtgttgtaccaggacgtgaattgtacagaagtccctgttgctatccacgccgatcagctgaccccaacatggcgcgtgtatagcactggctccaacgtgtttcaaaccagagcagggtgcctcatcggagccgagcatgtaaacaattcatacgaatgtgacattcccatcggcgctggtatttgcgcgagttatcagacgcagaccaactctcctaggcgggcacgcagcgtcgcctcccagtcaataatcgcttacacaatgagcctgggggccgaaaattctgtggcatactccaacaatagtattgccatcccaactaacttcaccatcagcgttacaactgaaattcttcccgtgtctatgaccaagacgtccgtcgattgtacaatgtatatatgcggcgactcaaccgagtgtagtaatctgttgctccaatacggatctttttgcactcagctgaacagagctttaacaggcatcgccgtggagcaggataaaaatacccaggaagttttcgcacaagtgaagcagatttataaaactccgcctatcaaggactttgggggattcaacttttcgcagattctgccagatccctccaaaccttctaagaggagcttcatcgaggacctactctttaataaggtaaccctggcggatgctggtttcataaaacaatacggcgactgtcttggggatatcgccgcacgtgacttgatttgcgcccagaagttcaacggactgacagtcctgcccccactcttaacggatgaaatgatcgctcagtatacctcagccctgcttgcaggcactattacaagtggttggacctttggggctggcgccgcgttgcagatccctttcgccatgcaaatggcttaccggtttaatggaataggcgtgacacagaacgtgctctatgagaatcagaaactgattgcaaaccagttcaactccgccatcgggaagattcaagactctctaagctccactgcttcagccctgggaaaactccaggacgtcgttaatcagaacgcacaggcgctgaatacccttgtgaagcaattgagcagtaactttggcgccatctcttccgtactgaatgatatattaagccgactcgacaaggtggaagctgaggtccagatcgatagactgattacgggtaggcttcagtcgctgcaaacatacgtgacccagcagttgatccgcgccgcagagattcgggcttcagccaacctcgcagccactaaaatgtctgaatgcgttctggggcagagtaagagagtggacttctgtggaaaaggctaccacctaatgtcctttccccaaagcgctccacatggtgtcgtgttcctgcacgttacctatgtgccggcgcaggagaagaattttacaactgcccctgcaatctgccacgatggcaaagctcatttccccagggaaggggtctttgtatctaacggaacccactggttcgtgacacagcgcaatttttacgagccacagataattacgaccgacaacactttcgttagcggcaattgtgatgtggtcatcgggatcgtgaacaatacagtatatgaccccctccaacctgagctggattccttcaaggaagaacttgacaaatactttaagaaccatacctcaccagatgtggacttgggagatattagtggcatcaatgccagcgtcgttaacattcagaaggaaatagaccgactgaatgaggtggccaaaaacttaaacgaatctctcatcgacctgcaggagcttggtaagtatgagcagtacattaaatggccctggtatatctggctggggttcattgctggactaatcgcaatagtgatggtcactatcatgctctgctgtatgacatcctgctgttcatgcctgaagggctgttgcagttgtggtagctgctgcaaatttgatgaagacgattccgagcctgtgttgaagggcgttaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12993 - RNA, 4039 nt, synthetic construct
  misc_feature 1..4039: note = SARS-CoV-2/Portugal/PT0035/2020__EPI_ISL_418020 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacacgaatagcttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggatctttttgcacccagctgaacagagccttaactggcatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatctcagcacgtgacttgatttgcgcccagaagttcaacggactgaccgtcctgcccccactcttaacagatgaaatgatcgctcagtatacgagtgccctgcttgcaggcaccattacttccggttggacatttggggctggcgccgcgttgcagatccctttcgccatgcaaatggcttaccggtttaatggaataggcgtgacccagaacgtgctctatgagaatcagaaactgattgcaaaccagttcaactctgccatcgggaagattcaagacagcctatcctcaacagctagcgccctgggaaaactccaggacgtcgttaatcagaacgcacaggcgctgaatactcttgtgaagcaattgagttctaactttggcgccatctccagcgtactgaatgatatattatcgcgactcgacaaggtggaagctgaggtccagatcgatagactgattaccggtaggcttcagtcactgcaaacgtacgtgacacagcagttgatccgcgccgcagagattcgggcttctgccaacctcgcagccaccaaaatgagtgaatgcgttctggggcagtccaagagagtggacttctgtggaaaaggctaccacctaatgagctttccccaatctgctccacatggtgtcgtgttcctgcacgttacttatgtgccggcgcaggagaagaattttaccacagcccctgcaatctgccacgatggcaaagctcatttccccagggaaggggtctttgtaagcaacggaactcactggttcgtgacccagcgcaatttttacgagccacagataattacaacggacaacaccttcgtttccggcaattgtgatgtggtcatcgggatcgtgaacaatactgtatatgaccccctccaacctgagctggattcattcaaggaagaacttgacaaatactttaagaaccatacaagtccagatgtggacttgggagatattagcggcatcaatgcctctgtcgttaacattcagaaggaaatagaccgactgaatgaggtggccaaaaacttaaacgaatccctcatcgacctgcaggagcttggtaagtatgagcagtacattaaatggccctggtatatctggctggggttcattgctggactaatcgcaatagtgatggtcaccatcatgctctgctgtatgacttcatgctgtagttgcctgaagggctgttgcagctgtggttcctgctgcaaatttgatgaagacgattctgagcctgtgttgaagggcgttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12994 - RNA, 4039 nt, synthetic construct
  misc_feature 1..4039: note = SARS-CoV-2/USA/NY-NYUMC7/2020__EPI_ISL_418192 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctaccatcacaaaaataacaagtcctggatggagtctgagttccgtgtgtatagctccgcgaataactgtacttttgagtacgtgtcacaacctttcctgatggacctggaaggcaagcagggtaattttaaaaacctcagagagttcgtctttaagaacattgatgggtatttcaaaatctacagtaagcataccccaataaatttagttagggacctgccccagggatttagcgctcttgagcctttggtggatctgccaatcggcattaacatcacacggttccagactctactcgccctgcaccgctcttaccttaccccgggcgactcctcaagcgggtggacagcaggagccgctgcatattacgtaggttatctgcaacccagaacctttttgctcaaatacaatgaaaacggcacgattactgatgccgtggactgcgctctggatcctttaagtgagacaaagtgtaccctgaagtctttcactgtcgaaaaagggatctatcagacatccaattttagggtgcagccaaccgagagcatagttcggttccccaacattacgaatctctgcccttttggagaggtgttcaacgccacccgcttcgcgtcggtctacgcatggaatcgaaagagaatctctaactgtgtggccgactattccgtactttacaattcagctagttttagcacattcaaatgctacggcgtttccccaactaagctgaacgacttgtgttttaccaatgtgtatgccgattctttcgtcattaggggtgacgaagtgcggcagatcgcacccgggcaaacaggaaaaatcgctgattacaactataagctaccggacgattttactggctgcgtcattgcctggaatagcaacaacctggactcaaaagtgggcgggaattacaactatctctaccgtctgttccgcaagagtaatcttaagccttttgagagagatatatccaccgaaatctatcaggcgggaagcacaccctgtaacggtgttgagggcttcaattgctactttccactgcagtcttacgggttccaacctaccaacggagtgggctatcagccctacagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtatcagggcgtgaattgtactgaagtccctgttgccatccatgcagaccagctgacaccaacctggcgcgtgtacagcacagggtccaacgtgtttcaaactagagccggatgcctcatcggcgctgagcacgtaaacaattcatatgaatgtgatattcccatcggtgcggggatttgcgcaagttaccagacccagacgaactctcctaggcgggcccgcagcgtcgcttcccagtcaataatcgcctataccatgagcctgggcgcagaaaattctgtggcctactccaacaatagtattgctatcccaacaaacttcactatcagcgttaccacagaaattcttcccgtgtctatgactaagacctccgtcgactgtacgatgtacatatgcggagattcaacagagtgtagtaatctgttgctccaatatggcagcttttgcacccagctgaacagagccttaactgggatcgcagtggagcaggacaaaaatacacaggaagttttcgcgcaagtgaagcagatttacaaaaccccgcctatcaaggattttggaggtttcaacttttcgcagattctgccagacccctccaaaccttctaagaggagcttcatcgaggatctactctttaataaggtaactctggctgacgccggcttcataaaacaatatggggattgtcttggagacatcgcagcccgtgatttgatttgcgctcagaagttcaacggcctgaccgtcctgcccccactcttaacagacgaaatgatcgcccagtacacgtcagcactgcttgctggtaccattacgagtgggtggacatttggcgccggagcggccttgcagatccctttcgctatgcaaatggcatatcggtttaatggcataggggtgacccagaacgtgctctacgagaatcagaaactgattgccaaccagttcaactccgctatcggaaagattcaagattctctaagctccacagcctcagcactgggcaaactccaggacgtcgttaatcagaacgcgcaggccctgaatactcttgtgaagcaattgagcagtaactttggtgctatctcttccgtactgaatgacatattaagccgactcgataaggtggaagccgaggtccagatcgacagactgattaccgggaggcttcagtcgctgcaaacgtatgtgacacagcagttgatccgcgcagctgagattcgggcctcagcaaacctcgccgctaccaaaatgtctgaatgcgttctgggacagagtaagagagtggatttctgtggcaaaggttaccatctaatgtcctttccccaaagcgcgccacacggcgtcgtgttcctgcacgttacttacgtgccggcccaggagaagaattttaccacagctcctgcaatctgccatgacgggaaagcccacttccccagggaaggagtctttgtatctaacggcactcattggttcgtgacccagcgcaatttttatgagccacagataattacaacggataacaccttcgttagcgggaattgtgacgtggtcatcggaatcgtgaacaatactgtatacgatcccctccaacctgagctggactccttcaaggaagaacttgataaatattttaagaaccacacatcaccagacgtggatttgggcgacattagtggtatcaatgccagcgtcgttaacattcagaaggaaatagatcgactgaatgaggtggctaaaaacttaaacgaatctctcatcgacctgcaggagcttgggaagtacgagcagtatattaaatggccctggtacatctggctgggattcattgcaggcctaatcgccatagtgatggtcaccatcatgctctgctgtatgacttcctgctgttcatgcctgaagggttgttgcagttgtggcagctgctgcaaatttgacgaagatgactccgagcctgtgttgaagggggttaagctgcattatacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12995 - RNA, 4039 nt, synthetic construct
  misc_feature 1..4039: note = SARS-CoV-2/Iceland/189/2020__EPI_ISL_417709 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacaccaattctttcacgaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcaccaaacaatacggggattgtcttggagacatagcagcccgtgatttgatctgcgctcagaagttcaacggcctgacagtcctccctccactgttaacggacgaaatgattgcccagtatacctcagcactgcttgctggtactatcacaagtgggtggacctttggcgccggagcggccttgcagattcctttcgctatgcaaatggcataccggtttaatggcatcggggtgacacagaacgtgctctatgagaatcagaaactgatagccaaccagttcaactccgctattggaaagatccaagattctctaagctccactgcctcagcactgggcaaactccaggacgtcgttaatcagaacgcgcaggccctgaatacccttgtgaagcaattgagcagtaactttggtgctatttcttccgtactgaatgacatcttaagccgactcgataaggtggaagccgaggtccagatagacagactgatcacggggaggcttcagtcgctgcaaacatacgtgacccagcagttgattcgcgcagctgagatccgggcctcagcaaacctcgccgctactaaaatgtctgaatgcgttctgggacagagtaagagagtggatttctgtggcaaaggttaccacctaatgtcctttccccaaagcgcgccacatggcgtcgtgttcctgcacgttacctatgtgccggcccaggagaagaattttacaactgcacccgctatttgccacgacgggaaagcccatttccccagggaaggagtctttgtatctaacggcacccactggttcgtgacacagcgcaatttttacgagccacagatcataacgaccgataacactttcgttagcgggaattgtgacgtggtcattggaatcgtgaacaatacagtatatgatcccctccaacctgagctggactccttcaaggaagaacttgataaatactttaagaaccatacctcaccagacgtggatttgggcgacatcagtggtattaatgccagcgtcgttaacatccagaaggaaattgatcgactgaatgaggtggctaaaaacttaaacgaatctctcatagacctgcaggagcttgggaagtatgagcagtacatcaaatggccctggtatatttggctgggattcatcgcaggcctaattgccatcgtgatggtcactataatgctctgctgtatgacatcctgctgttcatgcctgaagggttgttgcagttgtggcagctgctgcaaatttgacgaagatgactccgagcctgtgttgaagggggttaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12996 - RNA, 4039 nt, synthetic construct
  misc_feature 1..4039: note = SARS-CoV-2/Australia/NSW56/2020__EPI_ISL_417408 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacacgaatagcttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggatctttttgcacccagctgaacagagccttaactggcatcgcagtggagcaggataaaaatacacaggaagttttcgcgcaagtgaagcagatttataaaaccccgcctatcaaggactttgggggattcaacttttcgcagattctgccagattcctctaaacccagcaagaggtcattcatcgaggacctactctttaataaggtaactctggctgatgccggtttcataaaacaatacggcgactgtcttggggatatcgcagcccgtgacttgatttgcgctcagaagttcaacggactgaccgtcctccctcccctgttaacagatgaaatgatcgcccagtatacgagtgcactgcttgctggcaccattacttccggttggacatttggggccggcgcggccttgcagatcccattcgctatgcaaatggcataccggtttaatggaataggcgtgacccagaacgtgctctatgagaatcagaaactgattgccaaccagttcaactctgctatcgggaagattcaagacagcctatcctcaacagccagcgcactgggaaaactccaggacgtcgttaatcagaacgcgcaggccctgaatactcttgtgaagcaattgagttctaactttggcgctatctccagcgtactgaatgatatattatcgcgactcgacaaggtggaagccgaggtccagatcgatagactgattaccggtaggcttcagtcactgcaaacgtacgtgacacagcagttgatccgcgcagctgagattcgggcctctgcaaacctcgccgctaccaaaatgagtgaatgcgttctggggcagtccaagagagtggacttctgtggaaaaggctaccacctaatgagctttcctcaatctgcgccccatggtgtcgtgttcctgcacgttacttatgtgccagcccaggagaagaattttaccacagcaccggctatctgccacgatggcaaagcccatttccctagggaaggggtctttgtaagcaacggaactcactggttcgtgacccagcgcaatttttacgagccccagataattacaacggacaacaccttcgtttccggcaattgtgatgtggtcatcgggatcgtgaacaatactgtatatgacccactccaacccgagctggattcattcaaggaagaacttgacaaatactttaagaaccatacaagtcctgatgtggacttgggagatattagcggcatcaatgcctctgtcgttaacattcagaaggaaatagaccgactgaatgaggtggctaaaaacttaaacgaatccctcatcgacctgcaggagcttggtaagtatgagcagtacattaaatggccatggtatatctggctggggttcattgcaggactaatcgccatagtgatggtcaccatcatgctctgctgtatgacttcatgctgtagttgcctgaagggctgttgcagctgtggttcctgctgcaaatttgatgaagacgattctgagcccgtgttgaagggcgttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12997 - RNA, 4039 nt, synthetic construct
  misc_feature 1..4039: note = SARS-CoV-2/Iceland/280/2020__EPI_ISL_417608 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcacacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccagtacggcagcttttgcacccaactgaacagagccttaactgggatcgcagtggagcaggacaaaaatacacaggaagttttcgcacaggtgaagcaaatttataaaaccccgcctatcaaggattttggaggtttcaacttttcgcagattctgccagacccctccaaaccttctaagaggagcttcatcgaggatctactctttaataaggtaactctggctgacgccggcttcataaaacagtacggggattgtcttggagacatcgcagcccgtgatttgatttgcgctcaaaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcagatggcataccggtttaatggcataggggtgacccaaaacgtgctctatgagaatcagaaactgattgccaaccagttcaactccgctatcggaaagattcaggattctctaagctccacagcctcagcactgggcaaactccaagacgtcgttaatcagaacgcgcaggccctgaatactcttgtgaagcagttgagcagtaactttggtgctatctcttccgtactgaatgacatattaagccgactcgataaggtggaagccgaggtccaaatcgacagactgattaccgggaggcttcagtcgctgcagacgtacgtgacacaacagttgatccgcgcagctgagattcgggcctcagcaaacctcgccgctaccaaaatgtctgaatgcgttctgggacagagtaagagagtggatttctgtggcaaaggttaccatctaatgtcctttccccagagcgcgccacacggcgtcgtgttcctgcacgttacttatgtgccggcccaagagaagaattttaccacagcgcctgctatctgccatgacgggaaagcccacttccccagggaaggagtctttgtatctaacggcactcattggttcgtgacccagcgcaatttttacgagccacagataattacaacggataacaccttcgttagcgggaattgtgacgtggtcatcggaatcgtgaacaatactgtatatgatcccctccagcctgagctggactccttcaaggaagaacttgataaatactttaagaaccacacatcaccagacgtggatttgggcgacattagtggtatcaatgccagcgtcgttaacattcaaaaggaaatagatcgactgaatgaggtggctaaaaacttaaacgaatctctcatcgacctgcaggagcttgggaagtatgagcagtacattaaatggccctggtatatctggctgggattcattgcaggcctaatcgccatagtgatggtcaccatcatgctctgctgtatgacttcctgctgttcatgcctgaagggttgttgcagttgtggcagctgctgcaaatttgacgaagatgactccgagcctgtgttgaagggggttaagctgcattacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12998 - RNA, 4039 nt, synthetic construct
  misc_feature 1..4039: note = SARS-CoV-2/Iceland/247/2020__EPI_ISL_417575 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctaagctccacagcctcagcactgggcaaactccaggacgtcgttaatcagaacgcgcaggccctgaatactcttgtgaagcaattgagcagtaactttggtgctatctcttccgtactgaatgacatattaagccgactcgataaggtggaagccgaggtccagatcgacagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggatttctgtggcaaaggttaccacctaatgtcctttccccaaagcgcgccacatggcgtcgtgttcctgcacgttacttatgtgccggcccaggagaagaattttaccacagctcctgcaatctgccacgacgggaaagcccatttccccagggaaggagtctttgtatctaacggcactcactggttcgtgacccagcgcaatttttacgagccacagataattacaacggataacaccttcgttagcgggaattgtgacgtggtcatcggaatcgtgaacaatactgtatatgatcccctccaacctgagctggactccttcaaggaagaacttgataaatactttaagaaccatacatcaccagacgtggatttgggcgacattagtggtatcaatgccagcgtcgttaacattcagaaggaaatagatcgactgaatgaggtggctaaaaacttaaacgaatctctcatcgacctgcaggagcttgggaagtatgagcagtacattaaatggccctggtatatctggctgggattcattgcaggcctaatcgccatagtgatcgtcaccattatgctctgctgtatgacttcctgctgttcatgcctgaagggttgttgcagttgtggcagctgctgcaaatttgacgaagatgactccgagcctgtgttgaagggggttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12999 - RNA, 4039 nt, synthetic construct
  misc_feature 1..4039: note = SARS-CoV-2/Iceland/238/2020__EPI_ISL_417566 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgtcggcttcataaaacaatacggggattgtcttggagacatcgccgcacgtgatttgatttgcgcccagaagttcaacggcctgaccgtgctgcccccactcttaacagacgaaatgatcgctcagtatacgtcagccctgcttgcaggtaccattacgagtgggtggacatttggcgctggagccgcgttgcagatccctttcgccatgcaaatggcttaccggtttaatggcataggggtgacccagaacgtcctctatgagaatcagaaactgattgcaaaccagttcaactccgccatcggaaagattcaagattctctaagctccacagcttcagccctgggcaaactccaggacgttgtgaatcagaacgcacaggcgctgaatactcttgtaaagcaattgagcagtaactttggtgccatctcttccgtgctgaatgacatattaagccgactcgataaggtcgaagctgaggtgcagatcgacagactgattaccgggaggcttcagtcgctgcaaacgtacgttacacagcagttgatccgcgccgcagagattcgggcttcagccaacctcgcagccaccaaaatgtctgaatgcgtgctgggacagagtaagagagtcgatttctgtggcaaaggttaccacctaatgtcctttccccaaagcgctccacatggcgtggttttcctgcacgtgacttatgtcccggcgcaggagaagaattttaccacagcccctgcaatctgccacgacgggaaagctcatttccccagggaaggagtatttgtgtctaacggcactcactggttcgttacccagcgcaatttttacgagccacagataattacaacggataacaccttcgtgagcgggaattgtgacgtcgtgatcggaatcgtaaacaatactgtgtatgatcccctccaacctgagctggactccttcaaggaagaacttgataaatactttaagaaccatacatcaccagacgtcgatttgggcgacattagtggtatcaatgccagcgttgtgaacattcagaaggaaatagatcgactgaatgaggtggccaaaaacttaaacgaatctctcatcgacctgcaggagcttgggaagtatgagcagtacattaaatggccctggtatatctggctgggattcattgctggcctaatcgcaatagtcatggtgaccatcatgctctgctgtatgacttcctgctgttcatgcctgaagggttgttgcagttgtggcagctgctgcaaatttgacgaagatgactccgagcctgttttgaagggggtaaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13000 - RNA, 4039 nt, synthetic construct
  misc_feature 1..4039: note = SARS-CoV-2/Greece/16/2020__EPI_ISL_418265 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacgttgatgggtacttcaaaatttacagtaagcacaccccaatcaatttagtgagggacctgccccagggatttagcgctcttgagcctttggtagatctgccaataggcatcaacattacacggttccagactctactcgccctgcatcgctcttatcttaccccgggcgactcctcaagcgggtggacagcaggagccgctgcatactatgtgggttacctgcaacccagaacctttttgctcaaatataatgaaaacggcacgatcactgatgccgtcgactgcgctctggatcctttaagtgagacaaagtgtaccctgaagtctttcactgtggaaaaagggatttaccagacatccaattttagggttcagccaaccgagagcatcgtgcggttccccaacataacgaatctctgcccttttggagaggtcttcaacgccacccgcttcgcgtcggtgtatgcatggaatcgaaagagaatttctaactgtgtagccgactactccgttctttacaattcagctagttttagcacattcaaatgctatggcgtgtccccaactaagctgaacgacttgtgttttaccaatgtctacgccgattctttcgtgatcaggggtgacgaagtccggcagattgcacccgggcaaacaggaaaaatcgctgattataactacaagctaccggacgattttactggctgcgtgatcgcctggaatagcaacaacctggactcaaaagttggcgggaattataactacctctatcgtctgttccgcaagagtaatcttaagccttttgagagagatatttccaccgaaatataccaggcgggaagcacaccctgtaacggtgtggagggcttcaattgctactttccactgcagtcttatgggttccaacctaccaacggagtaggctaccagccctatagggtcgtggttttgtcatttgaactcctgcacgccccagcaactgtgtgcggtcccaaaaagagtacgaatttagtcaaaaacaagtgtgtgaatttcaactttaatgggctgacaggcaccggagtactaactgagagcaacaaaaagttcctccctttccagcagtttggccgggacatcgctgataccacagacgccgtgcgagatccacaaaccctggagattcttgacatcactccgtgctccttcgggggagtttctgtcataacacccggtacgaatacctcgaaccaggtggctgtgttgtaccaggacgtcaattgtactgaagttcctgtggccattcacgcagatcagctgacaccaacctggcgcgtgtatagcacaggctccaacgtatttcaaactagagccgggtgcctcatcggagctgagcatgtcaacaattcatacgaatgtgacatccccattggcgcgggtatctgcgcaagttatcagacccagacgaactctcctaggcgggcccgcagcgtggcttcccagtcaattatagcctacaccatgagcctgggggcagaaaattctgttgcctactccaacaatagtatcgctattccaacaaacttcactatcagcgtgaccacagaaatccttcccgtctctatgactaagacctccgtggattgtacgatgtatatttgcggcgactcaacagagtgtagtaatctgttgctccaatacggcagcttttgcacccagctgaacagagccttaactggaatagcagttgagcaggataaaaatacacaggaagtgttcgcgcaagtaaagcagatctataaaaccccgcctattaaggactttgggggattcaacttttcgcagatcctgccagatccctccaaaccttctaagaggagcttcattgaggacctactctttaataaggtcactctggctgatgccggtttcatcaaacaatacggcgactgtcttggggatatagcagcccgtgacttgatctgcgctcagaagttcaacggactgaccgtgctgcccccactcttaacagatgaaatgattgcccagtatacgtcagcactgcttgctggcaccatcacgagtggttggacatttggggccggcgcggccttgcagattcctttcgctatgcaaatggcataccggtttaatggaatcggcgtgacccagaacgtcctctatgagaatcagaaactgatagccaaccagttcaactccgctattgggaagatccaagactctctaagctccacagcctcagcactgggaaaactccaggacgttgtgaatcagaacgcgcaggccctgaatactcttgtaaagcaattgagcagtaactttggcgctatttcttccgtgctgaatgatatcttaagccgactcgacaaggtcgaagccgaggtgcagatagatagactgatcaccggtaggcttcagtcgctgcaaacgtacgttacacagcagttgattcgcgcagctgagatccgggcctcagcaaacctcgccgctaccaaaatgtctgaatgcgtgctggggcagagtaagagagtcgacttctgtggaaaaggctaccacctaatgtcctttccccaaagcgcgccacatggtgtggttttcctgcacgtgacttatgtcccggcccaggagaagaattttaccacagctcctgcaatttgccacgatggcaaagcccatttccccagggaaggggtatttgtgtctaacggaactcactggttcgttacccagcgcaatttttacgagccacagatcataacaacggacaacaccttcgtgagcggcaattgtgatgtcgtgattgggatcgtaaacaatactgtgtatgaccccctccaacctgagctggattccttcaaggaggaacttgacaaatactttaagaaccatacatcaccagatgtcgacttgggagatatcagtggcattaatgccagcgttgtgaacatccagaaggaaattgaccgactgaatgaggtggctaaaaacttaaacgaatctctcatagacctgcaggagcttggtaagtatgagcagtacatcaaatggccctggtatatttggctggggttcatcgcaggactaattgccatcgtcatggtgaccataatgctctgctgtatgacttcctgctgttcatgcctgaagggctgttgcagttgtggtagctgctgcaaatttgatgaagacgattccgagcctgttttgaagggcgtaaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13001 - RNA, 4039 nt, synthetic construct
  misc_feature 1..4039: note = SARS-CoV-2/Iceland/319/2020__EPI_ISL_417648 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgattgacctggaaggcaagcagggtaattttaaaaacctcagagagttcgtctttaagaacatcgatgggtacttcaaaatatacagtaagcacaccccaatcaatttagttagggacctgccccagggatttagcgctcttgagcctttggtggatctgccaattggcatcaacattacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgatcactgatgccgtggactgcgctctggatcctttaagtgagacaaagtgtaccctgaagtctttcactgtcgaaaaagggatataccagacatccaattttagggtgcagccaaccgagagcattgttcggttccccaacatcacgaatctctgcccttttggagaggtgttcaacgccacccgcttcgcgtcggtctatgcatggaatcgaaagagaatttctaactgtgtggccgactactccgtactttacaattcagctagttttagcacattcaaatgctatggcgtttccccaactaagctgaacgacttgtgttttaccaatgtgtacgccgattctttcgtcatcaggggtgacgaagtgcggcagatcgcacccgggcaaacaggaaaaattgctgattataactacaagctaccggacgattttactggctgcgtcatagcctggaatagcaacaacctggactcaaaagtgggcgggaattataactacctctatcgtctgttccgcaagagtaatcttaagccttttgagagagatatctccaccgaaatttaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacatcgctgataccacagacgccgtacgagatccacaaaccctggagatacttgacattactccgtgctccttcgggggagtgtctgttatcacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcattggcgctgagcatgtaaacaattcatacgaatgtgatatccccattggtgcggggatatgcgcaagttatcagacccagacgaactctcctaggcgggcccgcagcgtcgcttcccagtcaatcattgcctacaccatgagcctgggcgcagaaaattctgtggcctactccaacaatagtatcgctatcccaacaaacttcactattagcgttaccacagaaatacttcccgtgtctatgactaagacctccgtcgactgtacgatgtatatctgcggagattcaacagagtgtagtaatctgttgctccaatacggcagcttttgcacccagctgaacagagccttaactgggattgcagtggagcaggacaaaaatacacaggaagttttcgcgcaagtgaagcagatctataaaaccccgcctattaaggattttggaggtttcaacttttcgcagatcctgccagacccctccaaaccttctaagaggagcttcatagaggatctactctttaataaggtaactctggctgacgccggcttcatcaaacaatacggggattgtcttggagacattgcagcccgtgatttgatctgcgctcagaagttcaacggcctgaccgtcctgcccccactcttaacagacgaaatgattgcccagtatacgtcagcactgcttgctggtaccatcacgagtgggtggacatttggcgccggagcggccttgcagatacctttcgctatgcaaatggcataccggtttaatggcattggggtgacccagaacgtgctctatgagaatcagaaactgatcgccaaccagttcaactccgctattggaaagatccaagattctctaagctccacagcctcagcactgggcaaactccaggacgtcgttaatcagaacgcgcaggccctgaatactcttgtgaagcaattgagcagtaactttggtgctatatcttccgtactgaatgacatcttaagccgactcgataaggtggaagccgaggtccagattgacagactgatcaccgggaggcttcagtcgctgcaaacgtacgtgacacagcagttgattcgcgcagctgagatccgggcctcagcaaacctcgccgctaccaaaatgtctgaatgcgttctgggacagagtaagagagtggatttctgtggcaaaggttaccacctaatgtcctttccccaaagcgcgccacatggcgtcgtgttcctgcacgttacttatgtgccggcccaggagaagaattttaccacagctcctgcaatatgccacgacgggaaagcccatttccccagggaaggagtctttgtatctaacggcactcactggttcgtgacccagcgcaatttttacgagccacagattatcacaacggataacaccttcgttagcgggaattgtgacgtggtcatcggaattgtgaacaatactgtatatgatcccctccaacctgagctggactccttcaaggaagaacttgataaatactttaagaaccatacatcaccagacgtggatttgggcgacatcagtggtattaatgccagcgtcgttaacatacagaaggaaatcgatcgactgaatgaggtggctaaaaacttaaacgaatctctcattgacctgcaggagcttgggaagtatgagcagtacatcaaatggccctggtatatttggctgggattcatcgcaggcctaatagccatcgtgatggtcaccattatgctctgctgtatgacttcctgctgttcatgcctgaagggttgttgcagttgtggcagctgctgcaaatttgacgaagatgactccgagcctgtgttgaagggggttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13002 - RNA, 4039 nt, synthetic construct
  misc_feature 1..4039: note = SARS-CoV-2/Congo/94/2020__EPI_ISL_417947 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatatactatttaataaggtaactctcgctgacgccggcttcatcaaacaatacggggattgtctgggagacattgcagcccgtgatcttatctgcgctcagaagttcaacggcttgaccgtcctgcccccactcctgacagacgaaatgattgcccagtatacgtcagcattactggctggtaccatcacgagtgggtggacatttggcgccggagcggcccttcagatacctttcgctatgcaaatggcataccggtttaatggcattggggtgacccagaacgtgttgtatgagaatcagaaactcatcgccaaccagttcaactccgctattggaaagatccaagattctctgagctccacagcctcagcactaggcaaactgcaggacgtcgttaatcagaacgcgcaggccctcaatactctggtgaagcaacttagcagtaactttggtgctatatcttccgtattgaatgacatcctgagccgattagataaggtggaagccgaggtccagattgacagactcatcaccgggaggctgcagtcgcttcaaacgtacgtgacacagcagctgattcgcgcagctgagatccgggcctcagcaaacttggccgctaccaaaatgtctgaatgcgttctcggacagagtaagagagtggatttctgtggcaaaggttaccacctgatgtcctttccccaaagcgcgccacatggcgtcgtgttcctacacgttacttatgtgccggcccaggagaagaattttaccacagctcctgcaatatgccacgacgggaaagcccatttccccagggaaggagtctttgtatctaacggcactcactggttcgtgacccagcgcaatttttacgagccacagattatcacaacggataacaccttcgttagcgggaattgtgacgtggtcatcggaattgtgaacaatactgtatatgatcccctgcaacctgagctcgactccttcaaggaagaactggataaatactttaagaaccatacatcaccagacgtggatcttggcgacatcagtggtattaatgccagcgtcgttaacatacagaaggaaatcgatcgattgaatgaggtggctaaaaacctgaacgaatctttaattgacctccaggagctggggaagtatgagcagtacatcaaatggccctggtatatttggcttggattcatcgcaggcctgatagccatcgtgatggtcaccattatgctatgctgtatgacttcctgctgttcatgcctcaagggttgttgcagttgtggcagctgctgcaaatttgacgaagatgactccgagcctgtgctgaagggggttaagttgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13003 - RNA, 4039 nt, synthetic construct
  misc_feature 1..4039: note = SARS-CoV-2/Congo/158/2020__EPI_ISL_417950 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcctcagcggcaattgtgatgttgtgatcgggatcgtcaacaatactgtgtatgaccccctgcaacctgagcttgattccttcaaggaagagttggacaaatactttaagaaccatacatcaccagatgtagacctgggagatattagtggcatcaatgccagcgtggtcaacattcagaaggaaatagaccgattaaatgaggttgctaaaaacctcaacgaatctctgatcgaccttcaggagctgggtaagtatgagcagtacattaaatggccctggtatatctggctagggttcattgcaggactcatcgccatagtgatggtgaccatcatgctgtgctgtatgacttcctgctgttcatgcttgaagggctgttgcagttgtggtagctgctgcaaatttgatgaagacgattccgagcctgtcctgaagggcgtgaagttacactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13004 - RNA, 4039 nt, synthetic construct
  misc_feature 1..4039: note = SARS-CoV-2/USA/UT-00034/2020__EPI_ISL_417977 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactattacaaaaataacaagtcctggatggagtctgagttccgtgtgtatagctccgcgaataactgtacttttgagtacgtgtcacaacctttcctgatggacctggaaggcaagcagggtaattttaaaaacctcagagagttcgtctttaagaacattgatgggtacttcaaaatctatagtaagcataccccaataaatttagttagggacctgccccagggatttagcgctcttgagcctttggtggatctgccaatcggcattaacatcacacggttccagactctactcgccctgcaccgctcttaccttaccccgggcgactcctcaagcgggtggacagcaggagccgctgcatattacgtaggttatctgcaacccagaacctttttgctcaaatacaatgaaaacggcacgattactgatgccgtggactgcgctctggatcctttaagtgagacaaagtgtaccctgaagtctttcactgtcgaaaaagggatctatcagacatccaattttagggtgcagccaaccgagagcatagttcggttccccaacattacgaatctctgcccttttggagaggtgttcaacgccacccgcttcgcgtcggtctacgcatggaatcgaaagagaatctctaactgtgtggccgactactccgtactttataattcagctagttttagcacattcaaatgctacggcgtttccccaactaagctgaacgacttgtgttttaccaatgtgtatgccgattctttcgtcattaggggtgacgaagtgcggcagatcgcacccgggcaaacaggaaaaatcgctgattacaactataagctaccggacgattttactggctgcgtcattgcctggaatagcaacaacctggactcaaaagtgggcgggaattacaactatctctaccgtctgttccgcaagagtaatcttaagccttttgagagagatatatccaccgaaatctaccaggcgggaagcacaccctgtaacggtgttgagggcttcaattgctattttccactgcagtcttacgggttccaacctaccaacggagtgggctatcagccctacagggtagtcgtgttgtcatttgaactcctgcatgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtatcagggcgtgaattgtactgaagtccctgttgccatccacgcagaccagctgacaccaacctggcgcgtgtacagcacagggtccaacgtgtttcaaactagagccggatgcctcatcggcgctgagcacgtaaacaattcatatgaatgtgatattcccatcggtgcggggatttgcgcaagttaccagacccagacgaactctcctaggcgggcccgcagcgtcgcttcccagtcaataatcgcctacaccatgagcctgggcgcagaaaattctgtggcctattccaacaatagtattgctatcccaacaaacttcactatcagcgttaccacagaaattcttcccgtgtctatgactaagacctccgtcgactgtacgatgtacatatgcggagattcaacagagtgtagtaatctgttgctccaatatggcagcttttgcacccagctgaacagagccttaactgggatcgcagtggagcaggacaaaaatacacaggaagttttcgcgcaagtgaagcagatttacaaaaccccgcctatcaaggattttggaggtttcaacttttcgcagattctgccagacccctccaaaccttctaagaggagcttcatcgaggatctactctttaataaggtaactctggctgacgccggcttcataaaacaatatggggattgtcttggagacatcgcagcccgtgatttgatttgcgctcagaagttcaacggcctgaccgtcctgcccccactcttaacagacgaaatgatcgcccagtacacgtcagcactgcttgctggtaccattacgagtgggtggacatttggcgccggagcggccttgcagatccctttcgctatgcaaatggcatatcggtttaatggcataggggtgacccagaacgtgctctacgagaatcagaaactgattgccaaccagttcaactccgctatcggaaagattcaagattctctaagctccacagcctcagcactgggcaaactccaggacgtcgttaatcagaacgcgcaggccctgaatactcttgtgaagcaattgagcagtaactttggtgctatctcttccgtactgaatgacatattaagccgactcgataaggtggaagccgaggtccagatcgacagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggatttctgtggcaaaggttatcatctaatgtcctttccccaaagcgcgccacacggcgtcgtgttcctgcatgttacttacgtgccggcccaggagaagaattttaccacagctcctgcaatctgccacgacgggaaagcccacttccccagggaaggagtctttgtatctaacggcactcattggttcgtgacccagcgcaatttttatgagccacagataattacaacggataacaccttcgttagcgggaattgtgacgtggtcatcggaatcgtgaacaatactgtatacgatcccctccaacctgagctggactccttcaaggaagaacttgataaatattttaagaaccacacatcaccagacgtggatttgggcgacattagtggtatcaatgccagcgtcgttaacattcagaaggaaatagatcgactgaatgaggtggctaaaaacttaaacgaatctctcatcgacctgcaggagcttgggaagtacgagcagtatattaaatggccctggtacatctggctgggattcattgcaggcctaatcgccatagtgatggtcaccatcatgctctgctgtatgacttcctgctgttcatgcctgaagggttgttgcagttgtggcagctgctgcaaatttgacgaagatgactccgagcctgtgttgaagggggttaagctgcattacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13005 - RNA, 4039 nt, synthetic construct
  misc_feature 1..4039: note = SARS-CoV-2/USA/UT-00033/2020__EPI_ISL_417976 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggctgacagcaggagccgctgcatactatgtaggttacttgcaacccagaacctttctcctgaaatataatgaaaacggcacgattactgatgccgtggactgcgctttagatcctctgagtgagacaaagtgtaccctcaagtctttcactgtcgaaaaagggatctaccagacatccaattttagggtgcagccaaccgagagcatagttcggttccccaacattacgaatctttgcccttttggagaggtgttcaacgccacccgcttcgcgtcggtctatgcatggaatcgaaagagaatctctaactgtgtggccgactactccgtactgtacaattcagctagttttagcacattcaaatgctatggcgtttccccaactaagttgaacgacctatgttttaccaatgtgtacgccgattctttcgtcattaggggtgacgaagtgcggcagatcgcacccgggcaaacaggaaaaatcgctgattataactacaagctgccggacgattttactggctgcgtcattgcctggaatagcaacaacctcgactcaaaagtgggcgggaattataactacctgtatcgtcttttccgcaagagtaatctgaagccttttgagagagatatatccaccgaaatctaccaggcgggaagcacaccctgtaacggtgttgagggcttcaattgctactttccattgcagtcttatgggttccaacctaccaacggagtgggctaccagccctatagggtagtcgtgctctcatttgaactgttacacgccccagcaactgtttgcggtcccaaaaagagtacgaatctggtgaaaaacaagtgtgtcaatttcaactttaatgggctaacaggcaccggagtgctcactgagagcaacaaaaagttcctgcctttccagcagtttggccgggacattgctgataccacagacgccgtacgagatccacaaacccttgagatcttggacataactccgtgctccttcgggggagtgtctgttattacacccggtacgaatacctcgaaccaggtcgctgtgctgtaccagggcgtgaattgtactgaagtccctgttgccatccacgcagaccagctcacaccaacctggcgcgtgtatagcacagggtccaacgtgtttcaaactagagccggatgcctgatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagccttggcgcagaaaattctgtggcctactccaacaatagtattgctatcccaacaaacttcactatcagcgttaccacagaaattctgcccgtgtctatgactaagacctccgtcgactgtacgatgtatatatgcggagattcaacagagtgtagtaatttgctcctgcaatacggcagcttttgcacccagttaaacagagccctgactgggatcgcagtggagcaggacaaaaatacacaggaagttttcgcgcaagtgaagcagatttataaaaccccgcctatcaaggattttggaggtttcaacttttcgcagattctaccagacccctccaaaccttctaagaggagcttcatcgaggatctcctgtttaataaggtaactcttgctgacgccggcttcataaaacaatacggggattgtttgggagacatcgcagcccgtgatctgatttgcgctcagaagttcaacggcctcaccgtcctgcccccattactgacagacgaaatgatcgcccagtatacgtcagcacttttggctggtaccattacgagtgggtggacatttggcgccggagcggccctccagatccctttcgctatgcaaatggcataccggtttaatggcataggggtgacccagaacgtgctgtatgagaatcagaaactaattgccaaccagttcaactccgctatcggaaagattcaagattctctgagctccacagcctcagcactcggcaaactgcaggacgtcgttaatcagaacgcgcaggcccttaatactttggtgaagcaactgagcagtaactttggtgctatctcttccgtattaaatgacatactcagccgactggataaggtggaagccgaggtccagatcgacagacttattaccgggaggctgcagtcgttgcaaacgtacgtgacacagcagctcatccgcgcagctgagattcgggcctcagcaaacctggccgctaccaaaatgtctgaatgcgttctaggacagagtaagagagtggatttctgtggcaaaggttaccacctgatgtcctttccccaaagcgcgccacatggcgtcgtgttcctccacgttacttatgtgccggcccaggagaagaattttaccacagctcctgcaatctgccacgacgggaaagcccatttccccagggaaggagtctttgtatctaacggcactcactggttcgtgacccagcgcaatttttacgagccacagataattacaacggataacaccttcgttagcgggaattgtgacgtggtcatcggaatcgtgaacaatactgtatatgatcccctgcaacctgagcttgactccttcaaggaagagttggataaatactttaagaaccatacatcaccagacgtggatctgggcgacattagtggtatcaatgccagcgtcgttaacattcagaaggaaatagatcgattaaatgaggtggctaaaaacctcaacgaatctctgatcgaccttcaggagctggggaagtatgagcagtacattaaatggccctggtatatctggctaggattcattgcaggcctcatcgccatagtgatggtcaccatcatgctgtgctgtatgacttcctgctgttcatgcttgaagggttgttgcagttgtggcagctgctgcaaatttgacgaagatgactccgagcctgtgctgaagggggttaagttacactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13006 - RNA, 4039 nt, synthetic construct
  misc_feature 1..4039: note = SARS-CoV-2/USA/WI-13/2020__EPI_ISL_417516 spike protein mRNA human (1-1273)
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgctcccaaccgagagcatagttcggttccccaacattacgaatctttgcccttttggagaggtgttcaacgccacccgcttcgcgtcggtctatgcatggaatcgaaagagaatctctaactgtgtggccgactactccgtactgtacaattcagctagttttagcacattcaaatgctatggcgtttccccaactaagttgaacgacctatgttttaccaatgtgtacgccgattctttcgtcattaggggtgacgaagtgcggcagatcgcacccgggcagacaggaaaaatcgctgattataactacaagctgccggacgattttactggctgcgtcattgcctggaatagcaacaacctcgactcaaaagtgggcgggaattataactacctgtatcgtcttttccgcaagagtaatctgaagccttttgagagagatatatccaccgaaatctaccaagcgggaagcacaccctgtaacggtgttgagggcttcaattgctactttccattgcagtcttatgggttccagcctaccaacggagtgggctaccaaccctatagggtagtcgtgctctcatttgaactgttacacgccccagcaactgtttgcggtcccaaaaagagtacgaatctggtgaaaaacaagtgtgtcaatttcaactttaatgggctaacaggcaccggagtgctcactgagagcaacaaaaagttcctgcctttccagcagtttggccgggacattgctgataccacagacgccgtacgagatccacagacccttgagatcttggacataactccgtgctccttcgggggagtgtctgttattacacccggtacgaatacctcgaaccaagtcgctgtgctgtaccagggcgtgaattgtactgaagtccctgttgccatccacgcagaccagctcacaccaacctggcgcgtgtatagcacagggtccaacgtgtttcagactagagccggatgcctgatcggcgctgagcatgtaaacaattcatacgaatgtgatattcccatcggtgcggggatttgcgcaagttatcaaacccagacgaactctcctaggcgggcccgcagcgtcgcttcccagtcaataatcgcctacaccatgagccttggcgcagaaaattctgtggcctactccaacaatagtattgctatcccaacaaacttcactatcagcgttaccacagaaattctgcccgtgtctatgactaagacctccgtcgactgtacgatgtatatatgcggagattcaacagagtgtagtaatttgctcctgcagtacggcagcttttgcacccaattaaacagagccctgactgggatcgcagtggagcaggacaaaaatacacaggaagttttcgcacaggtgaagcaaatttataaaaccccgcctatcaaggattttggaggtttcaacttttcgcagattctaccagacccctccaaaccttctaagaggagcttcatcgaggatctcctgtttaataaggtaactcttgctgacgccggcttcataaaacagtacggggattgtttgggagacatcgcagcccgtgatctgatttgcgctcaaaagttcaacggcctcaccgtcctgcccccattactgacagacgaaatgatcgcccagtatacgtcagcacttttggctggtaccattacgagtgggtggacatttggcgccggagcggccctccagatccctttcgctatgcagatggcataccggtttaatggcataggggtgacccaaaacgtgctgtatgagaatcagaaactaattgccaaccagttcaactccgctatcggaaagattcaggattctctgagctccacagcctcagcactcggcaaactgcaagacgtcgttaatcagaacgcgcaggcccttaatactttggtgaagcagctgagcagtaactttggtgctatctcttccgtattaaatgacatactcagccgactggataaggtggaagccgaggtccaaatcgacagacttattaccgggaggctgcagtcgttgcagacgtacgtgacacaacagctcatccgcgcagctgagattcgggcctcagcaaacctggccgctaccaaaatgtctgaatgcgttctaggacagagtaagagagtggatttctgtggcaaaggttaccacctgatgtcctttccccagagcgcgccacatggcgtcgtgttcctccacgttacttatgtgccggcccaagagaagaattttaccacagcgcctgctatctgccacgacgggaaagcccatttccccagggaaggagtctttgtatctaacggcactcactggttcgtgacccagcgcaatttttacgagccacagataattacaacggataacaccttcgttagcgggaattgtgacgtggtcatcggaatcgtgaacaatactgtatatgatcccctgcagcctgagcttgactccttcaaggaagagttggataaatactttaagaaccatacatcaccagacgtggatctgggcgacattagtggtatcaatgccagcgtcgttaacattcaaaaggaaatagatcgattaaatgaggtggctaaaaacctcaacgaatctctgatcgaccttcaggagctggggaagtatgagcagtacattaaatggccctggtatatctggctaggattcattgcaggcctcatcgccatagtgatggtcaccatcatgctgtgctgtatgacttcctgctgttcatgcttgaagggttgttgcagttgtggcagctgctgcaaatttgacgaagatgactccgagcctgtgctgaagggggttaagttacactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13007 - RNA, 4036 nt, synthetic construct
  misc_feature 1..4036: note = SARS-CoV-2/India/1-27/2020__EPI_ISL_413522 spike protein mRNA human (1-1272)
  source 1..4036: mol_type = other RNA
aggagaaagcttaccatgttcgtgtttctggtcctccttcccctggttagctcccagtgcgtgaacttgaccacaagaactcaattacctccagcctacacgaatagcttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctaccataaaaataacaagtcctggatggagtctgagttccgtgtgtatagctccgcgaataactgtacttttgaatacgtgtcacaacctttcctgatggacctggaaggcaagcagggtaattttaaaaacctcagagagttcgtctttaagaacattgatgggtatttcaaaatctacagtaagcacaccccaataaatttagttagggacctgccccagggatttagcgctcttgagcctttggtggatctgccaatcggcattaacatcacacggttccagactctactcgccctgcatcgctcttaccttaccccgggcgactcctcaagcgggtggacagcaggagccgctgcatattacgtaggttatctgcaacccagaacctttttgctcaaatacaatgaaaacggcacgattactgatgccgtggactgcgctctggatcctttaagtgagacaaagtgtaccctgaagtctttcactgtcgaaaaagggatctatcagacatccaattttagggtgcagccaaccgagagcatagttcggttccccaacattacgaatctctgcccttttggagaggtgttcaacgccacccgcttcgcgtcggtctacgcatggaatcgaaagagaatctctaactgtgtggccgactattccgtactttacaattcagctagttttagcacattcaaatgctacggcgtttccccaactaagctgaacgacttgtgttttaccaatgtgtatgccgattctttcgtcattaggggtgacgaagtgatccagatcgcacccgggcaaacaggaaaaattgctgattacaactataagctaccggacgattttactggctgcgtcatagcctggaatagcaacaacctggactcaaaagtgggcgggaattacaactatctctaccggctgttccgtaagagtaatcttaagccttttgagcgcgatatctccaccgaaatttatcaggcgggaagcacaccctgtaacggtgttgagggcttcaattgctactttccactgcagtcttacgggttccaacctaccaacggagtgggctatcagccctacagagtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggcagggacatcgctgataccacagacgccgtacgggatccacaaaccctggagatacttgacattactccgtgctccttcgggggagtgtctgttatcacacccggtacgaatacctcgaaccaggtcgctgtgttgtatcaggacgtgaattgtactgaagtccctgttgccatccacgcagatcagctgacaccaacctggcgagtgtacagcacaggctccaacgtgtttcaaactcgcgccgggtgcctcattggagctgagcatgtaaacaattcatatgaatgtgacatccccattggcgcgggtatatgcgcaagttaccagacccagacgaactctcctagaagggcccggagcgtcgcttcccagtcaatcattgcctataccatgagcctgggggcagaaaattctgtggcctactccaacaatagtatcgctatcccaacaaacttcactattagcgttaccacagaaatacttcccgtgtctatgactaagacctccgtcgattgtacgatgtacatctgcggcgactcaacagagtgtagtaatctgttgctccaatatggatctttttgcacccagctgaaccgcgccttaactggcattgcagtggagcaggataaaaatacacaggaagttttcgcgcaagtgaagcagatctacaaaaccccgcctattaaggactttgggggattcaacttttcgcagatcctgccagatccctccaaaccttctaagagaagtttcatagaggacctactctttaataaggtaactctggctgatgccggtttcatcaaacaatatggcgactgtcttggggatattgcagccagggacttgatctgcgctcagaagttcaacggactgaccgtcctgcccccactcttaacagatgaaatgattgcccagtacacgtcagcactgcttgctggcaccatcactagcggttggacatttggggccggcgcggccttgcagatacctttcgctatgcaaatggcatatcgttttaatggaattggcgtgacccagaacgtgctctacgagaatcagaaactgatcgccaaccagttcaactccgctattgggaagatccaagactctctaagctccacagcctcagcactgggaaaactccaggacgtcgttaatcagaacgcgcaggccctgaatactcttgtgaagcaattgagcagtaactttggcgctatatcttccgtactgaatgatatcttaagccggctcgacaaggtggaagccgaggtccagattgatcgactgatcaccggtagacttcagtcgctgcaaacgtatgtgacacagcagttgattagggcagctgagatccgcgcctcagcaaacctcgccgctaccaaaatgtctgaatgcgttctggggcagagtaagcgggtggacttctgtggaaaaggctaccacctaatgtcctttccccaaagcgcgccacatggtgtcgtgttcctgcacgttacttacgtgccggcccaggagaagaattttaccacagctcctgcaatatgccacgatggcaaagcccatttccccagagaaggggtctttgtatctaacggaactcactggttcgtgacccagaggaatttttatgagccacagattatcacaacggacaacaccttcgttagcggcaattgtgatgtggtcatcgggattgtgaacaatactgtatacgaccccctccaacctgagctggattccttcaaggaggaacttgacaaatattttaagaaccatacatcaccagatgtggacttgggagatatcagtggcattaatgccagcgtcgttaacatacagaaggaaatcgaccgcctgaatgaggtggctaaaaacttaaacgaatctctcattgacctgcaggagcttggtaagtacgagcagtatatcaaatggccctggtacatttggctggggttcatcgcaggactaatagccatcgtgatggtcaccattatgctctgctgtatgacttcctgctgttcatgcctgaagggctgttgcagttgtggtagctgctgcaaatttgatgaagacgattccgagcctgtgttgaagggcgttaagctgcactatacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13008 - RNA, 4021 nt, synthetic construct
  misc_feature 1..4021: note = SARS-CoV-2/pangolin/Guangxi/P4L/2017__EPI_ISL_410538 spike protein mRNA human (1-1267)
  source 1..4021: mol_type = other RNA
aggagaaagcttaccatgttcgtgtttctgttcgtcctcccccttgttagctcccagtgcgtgaacctgaccacaagaactggcatccctccagggtacacgaatagctcaaccaggggagtatattacccggacaaggtgtttcggagtagcattttgcacttaacacaagatctgttcctaccctttttctccaacgtcacttggtttaataccataaactatcagggtggcttcaaaaagtttgacaatcctgtgctcccattcaacgatggggtttactttgcctctacagagaaatcgaatatcattcgcggatggatcttcggcaccactctggacgctcgaacacagtcacttctgattgtgaacaatgcaaccaacgtcgtgatcaaggtatgtgaatttcagttctgcacggatcccttcttgggtgtttattaccataataacaataaaacttgggtggagaacgaatttcgtgtctatagcagtgccaataactgtaccttcgagtacatatcccaaccttttctcatggacctggaagggaagcagggaaacttcaagaatctgagagagtttgtgttcaaaaacgtggatggctactttaagatctattctaaacacacaccaattgacctcgtcagggatttaccccggggcttcgcggctctggagcctcttgttgacttgccaatcgggattaatatcactcgctttcagaccctgctagccctccatagaagctacctgacaccgggaaaccttgaatccggttggaccacgggcgcagccgcttattacgtggggtatctgcagcaaaggactttcttgctctcatacaatcagaacggaacaataaccgatgcagtagactgcagtctggatcccttaagcgagactaagtgtacactgaaatctctcaccgtggaaaagggcatttatcagacgtccaattttcgggtccagcctaccatctcaattgtgcgcttcccaaacatcacaaatctttgcccctttggtgaggttttcaacgccagcaagttcgctagtgtgtacgcctggaatcgaaaaagaatctctaactgtgtcgcggactactccgtgctgtataatagcacttcgttttctaccttcaagtgctacggggtatcccctacaaaattgaacgacctatgttttactaatgtttatgcagattcattcgtggtcaagggagacgaggtgaggcaaattgccccaggccagaccggcgtcatagctgattacaactataaactgcccgacgattttacagggtgcgtgatcgcctggaacagtgttaagcaggacgcactcaccggaggtaattacggctatctgtaccggcttttccgtaaaagcaagctgaagccgtttgaacgcgatatttccactgagatctaccaagctgggtctacgccttgtaacggacaggtgggcttgaattgctattaccccctcgaaagatatggtttccacccaacaaccggggtaaactaccagccttttagggtcgtggttctgagcttcgagttactgaatggccccgccactgtgtgcggaccaaaactatcaaccacactcgtcaaggacaaatgtgtgaactttaatttcaacggcctgaccgggactggagtacttacaacgagtaagaaacagtttttgcccttccaacagttcggtcgggatatatccgacaccactgatgcggtgcgagaccctcagacactggaaattctcgacatcaccccatgcagctttggcggggtttctgtcatcacaccgggaactaatacctcaaaccaggtggccgtgctgtatcaagatgtcaattgtacggaggttcccatggcaattcatgctgagcagcttacccctgcctggcgcgtgtacagtgctggcgccaacgtgttccagacaagagcaggttgcctggtaggggccgaacacgtcaataacagctatgagtgtgacatcccagtgggcgctggaatttgcgcgtcctaccactctatgtcgagcttgaggtccgttaatcagcggtcaataatcgcatacactatgagtctcggcgccgaaaactctgtggcttatagcaacaattccattgccatccccaccaactttacaatctcagtcactaccgagattctgcctgtgagcatgacgaagacatctgttgattgtaccatgtacatatgcggggactccatcgaatgtagtaatttactgctacaatatggatctttctgcactcagctcaaccgcgcactgacaggtattgccgtggagcaggataagaatacccaggaggtatttgctcaagtcaaacagatctacaagactccacccattaaagacttcggcgggtttaacttctctcagatccttccggatccttccaagccatcaaaaagaagttttatagaagacttgctgttcaataaggtgaccctcgccgatgcaggatttatcaagcaatatggcgactgtctgggtgatattgcggctagggacttaatctgcgcccagaaattcaacgggctgacagtgcttccccctttgctcacggatgagatgattgcacagtacaccagcgccctgctagctggcactatcacatcgggatggaccttcggcgccggggcagctctgcagataccctttgccatgcaaatggcgtatcgtttcaatggaattggcgtcacacagaacgttctctacgaaaatcagaagctgatcgccaaccagtttaattccgctattggtaaaatccaagactctcttagctcaactgcaagtgccttggggaagctgcaggacgtggtaaaccagaatgctcaggccttaaacaccctcgtgaaacaactgtcctctaacttcggagcaataagctccgtccttaatgatatcctgtcacggttggacaaggtggaggcggaagttcagattgatcgactcatcacgggcagactgcagagcctacaaacatacgtgacccagcagctgattagggccgctgagatccgcgccagtgcaaacctcgctgccactaagatgtctgagtgcgtcctgggtcagtccaaacgggtggacttttgtggcaaggggtatcatcttatgagcttcccacaatcggcacctcacggagttgtgtttttgcatgtcacctacgtacccgcccaggagaaaaatttcacaactgctccagcgatatgccacgagggcaaggcccactttccgagagaaggggtgttcgtttcaaacggaacccattggtttattacacagaggaatttctatgagcctcagatcatcacgaccgataacacttttgtgtctggcagttgtgacgtcgtgattggtatcgtaaataacacagtgtacgatcccctgcaaccagagttagactccttcaaagaagaactcgataagtatttcaaaaatcacaccagccccgacgtcgatctgggggacatttctggaataaacgcaagcgttgtgaatatccagaaggaaattgatcgccttaacgaggtggctaagaatctgaacgaatcccctatcgacctacaggagctcggcaaatacgagcagtatattaagtggccatggtacatctggctgggttttatagccggcttgatcgccattatcatggtcactattatgctgtgctgtatgacatcatgctgtagttgcttaaaagggtgttgcagctgtggatcttgctgcaagttcgacgaagatgactccgagcccgtgctcaaaggcgttaagctgcattacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13009 - RNA, 4021 nt, synthetic construct
  misc_feature 1..4021: note = SARS-CoV-2/pangolin/Guangxi/P5L/2017__EPI_ISL_410540 spike protein mRNA human (1-1267)
  source 1..4021: mol_type = other RNA
aggagaaagcttaccatgttcgtgtttctgttcgtcctcccccttgttagctcccagtgcgtgaacctgaccacaagaactggcatccctccagggtacacgaatagctcaaccaggggagtatattacccggacaaggtgtttcggagtagcattttgcacttaacacaagatctgttcctaccctttttctccaacgtcacttggtttaataccataaactatcagggtggcttcaaaaagtttgacaatcctgtgctcccattcaacgatggggtttactttgcctctacagagaaatcgaatatcattcgcggatggatcttcggcaccactctggacgctcgaacacagtcacttctgattgtgaacaatgcaaccaacgtcgtgatcaaggtatgtgaatttcagttctgcacggatcccttcttgggtgtttattaccataataacaataaaacttgggtggagaacgaatttcgtgtctatagcagtgccaataactgtaccttcgagtacatatcccaaccttttctcatggacctggaagggaagcagggaaacttcaagaatctgagagagtttgtgttcaaaaacgtggatggctactttaagatctattctaaacacacaccaattgacctcgtcagggatttaccccggggcttcgcggctctggagcctcttgttgacttgccaatcgggattaatatcactcgctttcagaccctgctagccctccatagaagctacctgacaccgggaaaacttgaatccggttggaccacgggcgcagccgcttattacgtggggtatctgcagcaaaggactttcttgctctcatacaaccagaatggaacaataaccgatgcagtagactgcagtctggatcccttaagcgagactaagtgtacactgaagtctctcaccgtggaaaagggcatttatcagacgtccaactttcgggtccagcctaccatctcaattgtgcgcttcccaaatatcacaaacctttgcccctttggtgaggttttcaatgccagcaaattcgctagtgtgtacgcctggaaccgaaagagaatctctaattgtgtcgcggactactccgtgctgtataacagcacttcgttttctaccttcaaatgctacggggtatcccctacaaagttgaatgacctatgttttactaacgtttatgcagattcattcgtggtcaaaggagacgaggtgaggcaaattgccccaggccagaccggcgtcatagctgattacaattataagctgcccgacgattttacagggtgcgtgatcgcctggaacagtgttaaacaggacgcactcaccggaggtaactacggctatctgtaccggcttttccgtaagagcaagctgaaaccgtttgaacgcgatatttccactgagatctaccaagctgggtctacgccttgtaatggacaggtgggcttgaactgctattaccccctcgaaagatatggtttccacccaacaaccggggtaaattaccagccttttagggtcgtggttctgagcttcgagttactgaacggccccgccactgtgtgcggaccaaagctatcaaccacactcgtcaaagacaagtgtgtgaattttaacttcaatggcctgaccgggactggagtacttacaacgagtaaaaagcagtttttgcccttccaacagttcggtcgggatatatccgacaccactgatgcggtgcgagaccctcagacactggaaattctcgacatcaccccatgcagctttggcggggtttctgtcatcacaccgggaactaacacctcaaatcaggtggccgtgctgtatcaagatgtcaactgtacggaggttcccatggcaattcatgctgagcagcttacccctgcctggcgcgtgtacagtgctggcgccaatgtgttccagacaagagcaggttgcctggtaggggccgaacacgtcaacaatagctatgagtgtgacatcccagtgggcgctggaatttgcgcgtcctaccactctatgtcgagctttaggtccgttaaccagcggtcaataatcgcatacactatgagtttgggcgccgaaaattctgtggcttatagcaacaactccattgccatccccaccaatttcacaatctcagtcactaccgagattctccctgtgagcatgacgaagacatctgttgattgtaccatgtacatatgcggggactccatcgaatgtagtaacctgttactgcaatatggatctttttgcactcagctaaatcgcgcactcacaggtattgccgtggagcaggataaaaacacccaggaggtattcgctcaagtcaagcagatctacaaaactccacccattaaggactttggcgggttcaatttttctcagatcctgccggatccttccaaaccatcaaagagaagtttcatagaagaccttttgtttaacaaggtgaccctggccgatgcaggattcatcaaacaatatggcgactgtctcggtgatattgcggctagggacctgatctgcgcccagaagttcaatgggttaacagtgctgccccctcttttgacggatgagatgattgcacagtacaccagcgccctcctggctggcactatcacatcgggatggacctttggcgccggggcagctctacagatacccttcgccatgcaaatggcgtatcgttttaacggaattggcgtcacacagaatgttctgtacgaaaaccagaaactcatcgccaatcagttcaactccgctattggtaagatccaagactctctgagctcaactgcaagtgcccttgggaaattgcaggacgtggtaaatcagaacgctcaggccctgaataccttagtgaagcaactctcctctaactttggagcaataagctccgtcctgaacgatatcctttcacggctggacaaggtggaggcggaagttcagattgatcgattgatcacgggcagactccagagcctgcaaacatacgtgacccagcagctaattagggccgctgagatccgcgccagtgcaaatctggctgccactaaaatgtctgagtgcgtcctcggtcagtccaagcgggtggacttctgtggcaaagggtatcatctgatgagctttccacaatcggcacctcacggagttgtgttccttcatgtcacctacgtacccgcccaggaaaagaactttacaactgctccagcgatatgccacgagggcaaagcccacttcccgagagaaggggtgtttgtttcaaatggaacccattggttcattacacagaggaacttttatgagcctcagatcatcacgaccgataatactttcgtgtctggcagttgtgacgtcgtgattggtatcgtaaacaatacagtgtacgatcccttgcaaccagagctggactccttcaaggaagagttagataaatattttaagaaccacaccagccccgacgtcgatctcggggacatttctggaataaatgcaagcgttgtgaacatccagaaggaaattgatcgcctgaatgaggtggctaaaaaccttaatgaatccctgatcgacctacaggagctcggcaagtacgagcagtatattaaatggccttggtacatctggctgggtttcatagccggcttgatcgccattatcatggtcactattatgctgtgctgtatgacatcatgctgtagttgcttaaaggggtgttgcagctgtggatcttgctgcaaatttgacgaagatgactccgagccagtgctcaagggcgttaagctgcattacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13010 - RNA, 4021 nt, synthetic construct
  misc_feature 1..4021: note = SARS-CoV-2/pangolin/Guangxi/P5E/2017__EPI_ISL_410541 spike protein mRNA human (1-1267)
  source 1..4021: mol_type = other RNA
aggagaaagcttaccatgttcgtgtttctgttcgtcctcccccttgttagctcccagtgcgtgaacctgaccacaagaactggcatccctccagggtacacaaattcttcaaccaggggagtatattacccggacaaggtgtttcggagtagcattttgcacttaacacaagatctgttcctaccctttttctccaacgtcacttggtttaataccataacatatcagggtggctctaaaaagttcgacaaccctgtgctcccatttaatgatggggtttacttcgcctcgaccgagaaatcaaacatcattcgcggatggatctttggcactacactggacgctcgaacccagagccttctgattgtgaataacgcaacgaatgtcgtgatcaaggtatgtgagttccagttttgcactgatcccttcttgggtgtttattaccataacaataacaaaacctgggtggaaaatgagttccgtgtctatagttccgccaacaattgtacatttgaatacatatctcaacctttcctcatggacctggaagggaagcagggaaactttaagaacctgagagagttcgtgtttaaaaatgtggatggctacttcaagatctatagcaaacacactccaattgacctcgtcagggatttaccccggggctttgcggctctggagcctcttgttgacttgccaatcgggattaacatcacccgcttccagacactgctagccctccatagatcctacctgaccccgggaaaacttgaatcaggttggacgactggcgcagccgcttattacgtggggtatctgcagcaaaggacatttttgctcagttacaatcagaacggaaccataactgatgcagtagactgcagcctggatcccttatctgagacaaagtgtaccctgaagtccctcacggtggaaaagggcatttatcagacctcaaatttccgggtccagcctacaatcagcattgtgcgctttccaaacatcactaatctttgccccttcggtgaggtttttaacgccagtaaattcgcttctgtgtacgcctggaatcgaaagagaatctccaactgtgtcgcggactacagcgtgctgtataattcgacctctttctccacatttaaatgctacggggtatcacctactaagttgaacgacctatgtttcaccaatgtttatgcagatagttttgtggtcaaaggagacgaggtgaggcaaattgccccaggccagacaggcgtcatagctgattacaactataagctgcccgacgatttcaccgggtgcgtgatcgcctggaatagcgttaaacaggacgcactcactggagataactacggttatctgtaccggctttttcgtaagtccaagctgaaaccgttcgaacgcgacatttctacggagatctaccaagctggcagcacaccttgtaacggacaggtggggttgaattgctattaccccctcgaaagatatggctttcacccaaccactggtgtaaactaccagcctttcagggtcgtggttctgtcatttgagttactgaatgggcccgccaccgtgtgcggcccaaagctaagtacaaccctcgtcaaagataagtgtgtgaacttcaattttaacggactgactggcacaggggtacttacgacctccaaaaagcagttcttgccctttcaacagttcggacgggacataagcgatactacagacgcggtgcgagaccctcagaccctggaaattctcgatatcacaccatgctctttcggtggcgtttcagtcatcactccggggaccaatacgagtaaccaggtggccgtgctgtatcaagacgtcaattgtaccgaggttcccatggcaattcatgctgagcagcttacgcctgcctggcgcgtgtacagcgctggagccaacgtgtttcagactagagcaggctgcctggtaggtgccgaacacgtcaataactcctatgagtgtgatatcccagtgggggctggcatttgcgcgtcttaccactcgatgagctccttcaggtcagttaatcagcggagtataatcgcatacaccatgtctttgggagccgaaaacagcgtggcttattccaataactcaattgccatccccacaaactttactatcagcgtcaccacggagattctccctgtgtctatgacaaagacctccgttgactgtactatgtacatatgcggcgatagtatcgaatgtagcaatctgttactgcaatatgggtctttctgcacacagctaaaccgcgcactcaccggaattgccgtggagcaggacaaaaatactcaggaggtatttgctcaagtcaagcagatctacaaaaccccacccattaaggatttcggtggctttaacttctcccagatcctgccggacccttcaaaaccaagtaagaggagctttatagaagatcttttgttcaataaggtgacactggccgacgcagggtttatcaaacaatatggagattgtctcggcgacattgcggctagagatctgatctgcgcccagaagttcaacggtttaacggtgctgccccctcttttgaccgacgagatgattgcacagtacacttcggccctcctggctgggacaatcacctccggctggacattcggagccggcgcagctctacagataccctttgccatgcaaatggcgtatcgtttcaatgggattggagtcactcagaacgttctgtacgaaaatcagaaactcatcgccaaccagtttaattctgctattggcaagatccaagacagcctgtcaagtaccgcatccgcccttggtaaattgcaggatgtggtaaaccagaatgctcaggccctgaacacgttagtgaagcaactctctagcaatttcggggcaatatcctcagtcctgaacgacatccttagccggctggataaggtggaggcggaagttcagattgaccgattgatcacaggaagactccagagtctgcaaacctacgtgactcagcagctaattagggccgctgagatccgcgcctctgcaaacctggctgccaccaaaatgtccgagtgcgtcctcggccagagcaagcgggtggatttttgtggtaaaggctatcatctgatgtcgttcccacaatcagcacctcacggggttgtgtttcttcatgtcacatacgtacccgcccaggaaaagaatttcactaccgctccagcgatatgccacgagggaaaagcccactttccgagagaaggcgtgttcgtttctaacgggacacattggtttattacgcagaggaatttctatgagcctcagatcatcaccactgacaacacatttgtgagtggatcctgtgatgtcgtgattggcatcgtaaataacaccgtgtacgaccccttgcaaccagagctggatagcttcaaggaagagttagacaaatatttcaagaatcacacttctcccgatgtcgacctcggtgatattagcgggataaacgcatccgttgtgaatatccagaaggaaattgaccgcctgaacgaggtggctaaaaatcttaacgaatcactgatcgacctacaggagctcggaaagtacgagcagtatattaaatggccttggtacatctggctgggctttatagccggtttgatcgccattatcatggtcacaattatgctgtgctgtatgaccagttgctgtagctgcttaaagggctgttgctcttgtgggtcctgctgcaaattcgatgaagacgattcagagccagtgctcaagggagttaagctgcattacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13011 - RNA, 4015 nt, synthetic construct
  misc_feature 1..4015: note = SARS-CoV-2/pangolin/Guangxi/P1E/2017__EPI_ISL_410539 spike protein mRNA human (1-1265)
  source 1..4015: mol_type = other RNA
aggagaaagcttaccatgttcgtgtttctgttcgtcctcccccttgttagctcccagtgcgtgaacctgaccacaagaactggcatccaacctgggtacaccaattcttcaacgaggggagtatattacccagacaaggtgtttcggagtagcattttgcacttaacacaggatctgttcctaccgtttttctccaacgtcacttggtttaataccataaactatcagggtggcttcaagaagtttgacaatcccgtgctccctttcaacgatggggtttactttgcctctacagagaaatcgaatatcattcgcggatggatcttcggcaccactctggacgctcgaacacagtcacttctgattgtgaacaatgcaaccaacgtcgtgatcaaggtatgtgaatttcaattctgcacggatccattcttgggtgtttattaccataataacaataaaacttgggtggagaacgaatttcgtgtctatagcagtgccaataactgtaccttcgagtacatatcccagccctttctcatggacctggaagggaagcagggaaacttcaagaatctgagagagtttgtgttcaaaaacgtggatggctactttaagatctattctaaacacacacctattgacctcgtcagggatttaccacggggcttcgcggctctggagccccttgttgacttgcctatcgggattaatatcactcgctttcagaccctgctagccctccatagaagctacctgacaccaggaaaacttgaatccggttggaccacgggcgcagccgcttattacgtggggtatctgcaacagaggactttcttgctctcatacaaccagaatggaacaataaccgatgcagtagactgcagtctggatccgttaagcgagactaagtgtacactgaagtctctcaccgtggaaaagggcatttatcagacgtccaactttcgggtccaacccaccatctcaattgtgcgcttccctaatatcacaaacctttgcccatttggtgaggttttcaatgccagcaaattcgctagtgtgtacgcctggaaccgaaagagaatctctaattgtgtcgcggactactccgtgctgtataacagcacttcgttttctaccttcaaatgctacggggtatcccccacaaagttgaatgacctatgttttactaacgtttatgcagattcattcgtggtcaaaggagacgaggtgaggcagattgcccctggccagaccggcgtcatagctgattacaattataagctgccagacgattttacagggtgcgtgatcgcctggaacagtgttaaacaagacgcactcaccggaggtaactacctgtatcggcttttccgtaagagcaagctgaaaccctttgaacgcgatatttccactgagatctaccaggctggctctacgccgtgtaatggacaggtggggttgaactgctactatcctctcgaaagatacggcttccaccccacaaccggtgtaaattatcagccatttagggtcgtggttctgagcttcgagttactgaacgggcctgccactgtgtgcggccccaagctatcaaccacactcgtcaaagacaagtgtgtgaattttaacttcaatggactgaccggcactggggtacttacaacgagtaaaaagcaatttttgccattccagcagttcggacgggatatatccgacaccactgatgcggtgcgagacccccagacactggaaattctcgacatcaccccttgcagctttggtggcgtttctgtcatcacaccagggactaacacctcaaatcaagtggccgtgctgtaccaggatgtcaactgtacggaggttccgatggcaattcatgctgagcagcttacccccgcctggcgcgtgtatagtgctggagccaatgtgttccagacaagagcaggctgcctggtaggtgccgaacacgtcaacaatagctacgagtgtgacatccctgtgggggctggcatttgcgcgtcctatcactctatgtcgagcttgaggtccgttaaccaacggtcaataatcgcatacactatgagtctcggagccgaaaattctgtggcttacagcaacaactccattgccatcccaaccaattttacaatctcagtcactaccgagattctgcccgtgagcatgacgaagacatctgttgattgtaccatgtatatatgcggcgactccatcgaatgtagtaacttactgctacagtacgggagcttctgcactcagctcaatcgcgcactgacaggaattgccgtggagcaggataaaaacacccaagaggtatttgctcaggtcaagcagatctataaaactcctccaattaaggacttcggtggctttaatttctctcaaatccttcccgatccgtccaaaccttcaaagagaagttttatagaagacttgctgttcaacaaggtgaccctcgccgatgcagggtttatcaaacagtacggagactgtctgggcgatattgcggctagggacttaatctgcgcccagaagttcaatggtctgacagtgcttccacccttgctcacggatgagatgattgcacagtataccagcgccctgctagctgggactatcacatcgggctggaccttcggagccggcgcagctctgcaaataccttttgccatgcagatggcgtaccgtttcaacgggattggagtcacacagaatgttctctatgaaaaccagaaactgatcgccaatcaatttaactccgctattggcaagatccaggactctcttagctcaactgcaagtgccttgggtaaactgcaggacgtggtaaatcagaacgctcaagccttaaataccctcgtgaagcagctgtcctctaacttcggggcaataagctccgtccttaacgatatcctgtcacggttggacaaggtggaggcggaagttcagattgatcgactcatcacgggaagactgcaaagcctacagacatacgtgacccagcagctgattagggccgctgagatccgcgccagtgcaaatctcgctgccactaaaatgtctgagtgcgtcctgggccaatccaagcgggtggacttttgtggtaaaggctaccatcttatgagcttcccccagtcggcaccacacggggttgtgtttttgcatgtcacctatgtacctgcccaggaaaagaacttcacaactgctcccgcgatatgccacgagggaaaagcccactttccaagagaaggcgtgttcgtttcaaatgggacccattggtttattacacagaggaacttctacgagccgcaaatcatcacgaccgataatacttttgtgtctggaagttgtgacgtcgtgattggcatcgtaaacaatacagtgtatgatcctctgcagcccgagttagactccttcaaggaggaactcgataaatacttcaagaaccacaccagcccagacgtcgatctgggtgacatttctgggataaatgcaagcgttgtgaacatccagaaggaaattgatcgccttaatgaggtggctaaaaacctgaatgaatccctaatcgacctccaggagctgggaaagtatgagcaatacattaaatggccctggtatatctggttgggctttatagccggtctgatcgccattatcatggtcactattatgttatgctgtatgacatcatgctgtagttgcctcaagggctgttgcagctgtgggtcttgctgcaaattcgacgaagatgactccgagcctgtgctgaagggagttaaacttcattacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13012 - RNA, 4039 nt, synthetic construct
  misc_feature 1..4039: note = SARS-CoV-2/Wuhan/WIV05/2019__EPI_ISL_402128 spike protein mRNA gc mod (1-1273)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13013 - RNA, 4039 nt, synthetic construct; identical to SEQ ID NO: 165
  misc_feature 1..4039: note = SARS-CoV-2/Wuhan/WIV05/2019__EPI_ISL_402128 spike protein mRNA gc mod (1-1273)(K986P_V987P) R9519
  source 1..4039: mol_type = other RNA

SEQ ID NO: 13014 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_T887WN_A1020W)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13015 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_P1069F)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13016 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_ H1048Q_H1064N_ H1083N_H1101N)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13017 - RNA, 4039 nt, synthetic construct
  misc_feature 1..4039: note = SARS-CoV-2/Wuhan/WIV05/2019__EPI_ISL_402128 spike protein mRNA gc mod (1-1273)(I712C_T1077C)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13018 - RNA, 4039 nt, synthetic construct
  misc_feature 1..4039: note = SARS-CoV-2/Wuhan/WIV05/2019__EPI_ISL_402128 spike protein mRNA gc mod (1-1273)(I714C_Y1110C)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13019 - RNA, 4039 nt, synthetic construct
  misc_feature 1..4039: note = SARS-CoV-2/Wuhan/WIV05/2019__EPI_ISL_402128 spike protein mRNA gc mod (1-1273)(P715C_P1069C)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13020 - RNA, 4039 nt, synthetic construct
  misc_feature 1..4039: note = SARS-CoV-2/Wuhan/WIV05/2019__EPI_ISL_402128 spike protein mRNA gc mod (1-1273)(G889C_L1034C)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13021 - RNA, 4039 nt, synthetic construct
  misc_feature 1..4039: note = SARS-CoV-2/Wuhan/WIV05/2019__EPI_ISL_402128 spike protein mRNA gc mod (1-1273)(I909C_Y1047C)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13022 - RNA, 4039 nt, synthetic construct
  misc_feature 1..4039: note = SARS-CoV-2/Wuhan/WIV05/2019__EPI_ISL_402128 spike protein mRNA gc mod (1-1273)(Q965C_S1003C)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13023 - RNA, 4039 nt, synthetic construct
  misc_feature 1..4039: note = SARS-CoV-2/Wuhan/WIV05/2019__EPI_ISL_402128 spike protein mRNA gc mod (1-1273)(F970C_G999C)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13024 - RNA, 4039 nt, synthetic construct
  misc_feature 1..4039: note = SARS-CoV-2/Wuhan/WIV05/2019__EPI_ISL_402128 spike protein mRNA gc mod (1-1273)(A972C_R995C)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13025 - RNA, 4039 nt, synthetic construct
  misc_feature 1..4039: note = SARS-CoV-2/Wuhan/WIV05/2019__EPI_ISL_402128 spike protein mRNA gc mod (1-1273)(A890C_V1040C)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13026 - RNA, 4039 nt, synthetic construct
  misc_feature 1..4039: note = SARS-CoV-2/Wuhan/WIV05/2019__EPI_ISL_402128 spike protein mRNA gc mod (1-1273)(T874C_S1055C)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13027 - RNA, 2263 nt, synthetic construct; identical to SEQ ID NO: 168
  misc_feature 1..2263: note = SARS-CoV-2/Wuhan/WIV05/2019__EPI_ISL_402128 spike protein mRNA gc mod (1-681) R9518
  source 1..2263: mol_type = other RNA

SEQ ID NO: 13028 - RNA, 4333 nt, synthetic construct
  misc_feature 1..4333: note = SARS-CoV-2/Wuhan/WIV05/2019__EPI_ISL_402128 spike protein mRNA gc mod (1-1211) LumSynth construct
  source 1..4333: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13029 - RNA, 4333 nt, synthetic construct
  misc_feature 1..4333: note = SARS-CoV-2/Wuhan/WIV05/2019__EPI_ISL_402128 spike protein mRNA gc mod (1-1211)(K986P_V987P) LumSynth construct
  source 1..4333: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13030 - RNA, 4333 nt, synthetic construct
  misc_feature 1..4333: note = SARS-CoV-2/Wuhan/WIV05/2019__EPI_ISL_402128 spike protein mRNA gc mod (1-1211)(K986P_V987P_T887WN_A1020W) LumSynth construct
  source 1..4333: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13031 - RNA, 4333 nt, synthetic construct
  misc_feature 1..4333: note = SARS-CoV-2/Wuhan/WIV05/2019__EPI_ISL_402128 spike protein mRNA gc mod (1-1211)(K986P_V987P_P1069F) LumSynth construct
  source 1..4333: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13032 - RNA, 4333 nt, synthetic construct
  misc_feature 1..4333: note = SARS-CoV-2/Wuhan/WIV05/2019__EPI_ISL_402128 spike protein mRNA gc mod (1-1211)(K986P_V987P_ H1048Q_H1064N_ H1083N_H1101N) LumSynth construct
  source 1..4333: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt
